United States Patent 7,745,391 (HUMAN THROMBOSPONDIN POLYPEPTIDE) - sequence listing, part 257

SEQ ID NO: 735110 - DNA, 18856 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735111 - DNA, 19252 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735112 - DNA, 19294 bp, Homo sapiens
  misc_feature (19294)..(19294): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735113 - DNA, 18783 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735114 - DNA, 18573 bp, Homo sapiens
  misc_feature (18497)..(18497): n is a, c, g, or t
  misc_feature (18508)..(18508): n is a, c, g, or t
  misc_feature (18513)..(18513): n is a, c, g, or t
  misc_feature (18516)..(18516): n is a, c, g, or t
  misc_feature (18518)..(18518): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735115 - DNA, 18742 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735116 - DNA, 19138 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735117 - DNA, 19180 bp, Homo sapiens
  misc_feature (19180)..(19180): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735118 - DNA, 18669 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735119 - DNA, 18459 bp, Homo sapiens
  misc_feature (18383)..(18383): n is a, c, g, or t
  misc_feature (18394)..(18394): n is a, c, g, or t
  misc_feature (18399)..(18399): n is a, c, g, or t
  misc_feature (18402)..(18402): n is a, c, g, or t
  misc_feature (18404)..(18404): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735120 - DNA, 17278 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttggtccagatatgagcattgaattgtatcttcttgttaaaacactcagcataaaaggctgaaatgggtggatgatgggaaacctgctcagccacaaatgttagtcgagc

SEQ ID NO: 735121 - DNA, 16814 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgcttcagtttcgtcgacgcggccgc

SEQ ID NO: 735122 - DNA, 18799 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735123 - DNA, 19195 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735124 - DNA, 19237 bp, Homo sapiens
  misc_feature (19237)..(19237): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735125 - DNA, 18726 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735126 - DNA, 18516 bp, Homo sapiens
  misc_feature (18440)..(18440): n is a, c, g, or t
  misc_feature (18451)..(18451): n is a, c, g, or t
  misc_feature (18456)..(18456): n is a, c, g, or t
  misc_feature (18459)..(18459): n is a, c, g, or t
  misc_feature (18461)..(18461): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735127 - DNA, 18685 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735128 - DNA, 19081 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735129 - DNA, 19123 bp, Homo sapiens
  misc_feature (19123)..(19123): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735130 - DNA, 18612 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735131 - DNA, 18402 bp, Homo sapiens
  misc_feature (18326)..(18326): n is a, c, g, or t
  misc_feature (18337)..(18337): n is a, c, g, or t
  misc_feature (18342)..(18342): n is a, c, g, or t
  misc_feature (18345)..(18345): n is a, c, g, or t
  misc_feature (18347)..(18347): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735132 - DNA, 17221 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttggtccagatatgagcattgaattgtatcttcttgttaaaacactcagcataaaaggctgaaatgggtggatgatgggaaacctgctcagccacaaatgttagtcgagc

SEQ ID NO: 735133 - DNA, 16757 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgcttcagtttcgtcgacgcggccgc

SEQ ID NO: 735134 - DNA, 18760 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735135 - DNA, 19156 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735136 - DNA, 19198 bp, Homo sapiens
  misc_feature (19198)..(19198): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735137 - DNA, 18687 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735138 - DNA, 18477 bp, Homo sapiens
  misc_feature (18401)..(18401): n is a, c, g, or t
  misc_feature (18412)..(18412): n is a, c, g, or t
  misc_feature (18417)..(18417): n is a, c, g, or t
  misc_feature (18420)..(18420): n is a, c, g, or t
  misc_feature (18422)..(18422): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735139 - DNA, 18646 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735140 - DNA, 19042 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735141 - DNA, 19084 bp, Homo sapiens
  misc_feature (19084)..(19084): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735142 - DNA, 18573 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735143 - DNA, 18363 bp, Homo sapiens
  misc_feature (18287)..(18287): n is a, c, g, or t
  misc_feature (18298)..(18298): n is a, c, g, or t
  misc_feature (18303)..(18303): n is a, c, g, or t
  misc_feature (18306)..(18306): n is a, c, g, or t
  misc_feature (18308)..(18308): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735144 - DNA, 17182 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttggtccagatatgagcattgaattgtatcttcttgttaaaacactcagcataaaaggctgaaatgggtggatgatgggaaacctgctcagccacaaatgttagtcgagc

SEQ ID NO: 735145 - DNA, 16718 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgcttcagtttcgtcgacgcggccgc

SEQ ID NO: 735146 - DNA, 18772 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735147 - DNA, 19168 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735148 - DNA, 19210 bp, Homo sapiens
  misc_feature (19210)..(19210): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735149 - DNA, 18699 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735150 - DNA, 18489 bp, Homo sapiens
  misc_feature (18413)..(18413): n is a, c, g, or t
  misc_feature (18424)..(18424): n is a, c, g, or t
  misc_feature (18429)..(18429): n is a, c, g, or t
  misc_feature (18432)..(18432): n is a, c, g, or t
  misc_feature (18434)..(18434): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735151 - DNA, 18658 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735152 - DNA, 19054 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735153 - DNA, 19096 bp, Homo sapiens
  misc_feature (19096)..(19096): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735154 - DNA, 18585 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735155 - DNA, 18375 bp, Homo sapiens
  misc_feature (18299)..(18299): n is a, c, g, or t
  misc_feature (18310)..(18310): n is a, c, g, or t
  misc_feature (18315)..(18315): n is a, c, g, or t
  misc_feature (18318)..(18318): n is a, c, g, or t
  misc_feature (18320)..(18320): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735156 - DNA, 17194 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttggtccagatatgagcattgaattgtatcttcttgttaaaacactcagcataaaaggctgaaatgggtggatgatgggaaacctgctcagccacaaatgttagtcgagc

SEQ ID NO: 735157 - DNA, 16730 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgcttcagtttcgtcgacgcggccgc

SEQ ID NO: 735158 - DNA, 18733 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735159 - DNA, 19129 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttaaaaagagcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcc

SEQ ID NO: 735160 - DNA, 19171 bp, Homo sapiens
  misc_feature (19171)..(19171): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735161 - DNA, 18660 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735162 - DNA, 18450 bp, Homo sapiens
  misc_feature (18374)..(18374): n is a, c, g, or t
  misc_feature (18385)..(18385): n is a, c, g, or t
  misc_feature (18390)..(18390): n is a, c, g, or t
  misc_feature (18393)..(18393): n is a, c, g, or t
  misc_feature (18395)..(18395): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735163 - DNA, 18619 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcag

SEQ ID NO: 735164 - DNA, 19057 bp, Homo sapiens
  misc_feature (19057)..(19057): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaaaaaaaaaaaaaaaaacaaaaaaaagaacaaaataaaaaaaaagaaaacaacaaaaaaaaaaacaacaaaaaacaaaagagagggaggaggcgcaacaagcacaacgaagcactaccccgggagggggcacgccgcacacagaacgccggagcggcacgcccggaccccactatctagaaacgacaaagcgtgtgcccacacaaaacaaaagtaaaaagagcgcagacttatcaatcagacacacgccaagcgacgagacgcggccgcagatcctcaacaaacacagcacactgaatagcaaggtggagagaaacacaacctggtggctgacgcagcgacacacatcctgcgaaggaaaagacgagacactcacactaccatgggagagtggaggagcaaaacaacacacaggcgagaagaacaacaaaaacccagccacaccagcaaacataaacacgccaccatgacaacggcgacaacacaacaacgaccacgtctcaagcccgagtcactaactgagcacagacaacaccgcacacacaactacaatcagccgcggaacaaaggacaactaactacgaacgacaaccgactgatcagagcagagacaaacactcaactccaaccgagggagcgatcaaagaacaaataaggan

SEQ ID NO: 735165 - DNA, 18546 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaacaaaaatgctagtaaaatgataatgtaccgaaattggagaaatattcaattgtaactcacttttaaaaataataaaaccttagggggggtcccggtacaaatttccccttatagagggcggttttaaatttaattggcggcttttaacaacgtt

SEQ ID NO: 735166 - DNA, 18336 bp, Homo sapiens
  misc_feature (18260)..(18260): n is a, c, g, or t
  misc_feature (18271)..(18271): n is a, c, g, or t
  misc_feature (18276)..(18276): n is a, c, g, or t
  misc_feature (18279)..(18279): n is a, c, g, or t
  misc_feature (18281)..(18281): n is a, c, g, or t
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatggggnccccgggtggntaaanatngngccggtttaacccggggggaattcggggtaccacacaaaaccattgggaggcaca

SEQ ID NO: 735167 - DNA, 17155 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttggtccagatatgagcattgaattgtatcttcttgttaaaacactcagcataaaaggctgaaatgggtggatgatgggaaacctgctcagccacaaatgttagtcgagc

SEQ ID NO: 735168 - DNA, 16691 bp, Homo sapiens
gtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgcttcagtttcgtcgacgcggccgc

SEQ ID NO: 735169 - DNA, 4693 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735170 - DNA, 3799 bp, Homo sapiens
  misc_feature (3386)..(3386): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735171 - DNA, 4467 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735172 - DNA, 3573 bp, Homo sapiens
  misc_feature (3160)..(3160): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735173 - DNA, 4609 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735174 - DNA, 3715 bp, Homo sapiens
  misc_feature (3302)..(3302): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735175 - DNA, 4383 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735176 - DNA, 3489 bp, Homo sapiens
  misc_feature (3076)..(3076): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735177 - DNA, 4639 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735178 - DNA, 3745 bp, Homo sapiens
  misc_feature (3332)..(3332): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735179 - DNA, 4413 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735180 - DNA, 3519 bp, Homo sapiens
  misc_feature (3106)..(3106): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735181 - DNA, 4555 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735182 - DNA, 3661 bp, Homo sapiens
  misc_feature (3248)..(3248): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735183 - DNA, 4329 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735184 - DNA, 3435 bp, Homo sapiens
  misc_feature (3022)..(3022): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735185 - DNA, 5439 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735186 - DNA, 4545 bp, Homo sapiens
  misc_feature (4132)..(4132): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735187 - DNA, 5213 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735188 - DNA, 4319 bp, Homo sapiens
  misc_feature (3906)..(3906): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735189 - DNA, 5355 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735190 - DNA, 4461 bp, Homo sapiens
  misc_feature (4048)..(4048): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735191 - DNA, 5129 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735192 - DNA, 4235 bp, Homo sapiens
  misc_feature (3822)..(3822): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735193 - DNA, 5385 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735194 - DNA, 4491 bp, Homo sapiens
  misc_feature (4078)..(4078): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735195 - DNA, 5159 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735196 - DNA, 4265 bp, Homo sapiens
  misc_feature (3852)..(3852): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735197 - DNA, 5301 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735198 - DNA, 4407 bp, Homo sapiens
  misc_feature (3994)..(3994): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735199 - DNA, 5075 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735200 - DNA, 4181 bp, Homo sapiens
  misc_feature (3768)..(3768): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735201 - DNA, 4780 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735202 - DNA, 3886 bp, Homo sapiens
  misc_feature (3473)..(3473): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735203 - DNA, 4554 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735204 - DNA, 3660 bp, Homo sapiens
  misc_feature (3247)..(3247): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735205 - DNA, 4696 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735206 - DNA, 3802 bp, Homo sapiens
  misc_feature (3389)..(3389): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735207 - DNA, 4470 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735208 - DNA, 3576 bp, Homo sapiens
  misc_feature (3163)..(3163): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735209 - DNA, 4726 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735210 - DNA, 3832 bp, Homo sapiens
  misc_feature (3419)..(3419): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735211 - DNA, 4500 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735212 - DNA, 3606 bp, Homo sapiens
  misc_feature (3193)..(3193): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735213 - DNA, 4642 bp, Homo sapiens
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactc

SEQ ID NO: 735214 - DNA, 3748 bp, Homo sapiens
  misc_feature (3335)..(3335): n is a, c, g, or t
attacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataagtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 735215 - DNA, 6071 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735216 - DNA, 7570 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735217 - DNA, 7271 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735218 - DNA, 7570 bp, Homo sapiens
  misc_feature (6488)..(6488): n is a, c, g, or t
  misc_feature (6495)..(6495): n is a, c, g, or t
  misc_feature (6515)..(6517): n is a, c, g, or t
  misc_feature (6523)..(6523): n is a, c, g, or t
  misc_feature (6528)..(6528): n is a, c, g, or t
  misc_feature (6537)..(6537): n is a, c, g, or t
  misc_feature (6540)..(6541): n is a, c, g, or t
  misc_feature (6546)..(6546): n is a, c, g, or t
  misc_feature (6564)..(6564): n is a, c, g, or t
  misc_feature (6570)..(6571): n is a, c, g, or t
  misc_feature (6576)..(6577): n is a, c, g, or t
  misc_feature (6582)..(6582): n is a, c, g, or t
  misc_feature (6584)..(6584): n is a, c, g, or t
  misc_feature (6599)..(6599): n is a, c, g, or t
  misc_feature (6603)..(6604): n is a, c, g, or t
  misc_feature (6606)..(6607): n is a, c, g, or t
  misc_feature (6613)..(6613): n is a, c, g, or t
  misc_feature (6616)..(6617): n is a, c, g, or t
  misc_feature (6619)..(6620): n is a, c, g, or t
  misc_feature (6623)..(6624): n is a, c, g, or t
  misc_feature (6629)..(6629): n is a, c, g, or t
  misc_feature (6637)..(6637): n is a, c, g, or t
  misc_feature (6639)..(6639): n is a, c, g, or t
  misc_feature (6642)..(6642): n is a, c, g, or t
  misc_feature (6644)..(6644): n is a, c, g, or t
  misc_feature (6646)..(6647): n is a, c, g, or t
  misc_feature (6654)..(6654): n is a, c, g, or t
  misc_feature (6657)..(6657): n is a, c, g, or t
  misc_feature (6659)..(6659): n is a, c, g, or t
  misc_feature (6674)..(6675): n is a, c, g, or t
  misc_feature (6682)..(6682): n is a, c, g, or t
  misc_feature (6685)..(6685): n is a, c, g, or t
  misc_feature (6692)..(6692): n is a, c, g, or t
  misc_feature (6697)..(6697): n is a, c, g, or t
  misc_feature (6700)..(6700): n is a, c, g, or t
  misc_feature (6704)..(6704): n is a, c, g, or t
  misc_feature (6707)..(6707): n is a, c, g, or t
  misc_feature (6711)..(6711): n is a, c, g, or t
  misc_feature (6714)..(6714): n is a, c, g, or t
  misc_feature (6717)..(6717): n is a, c, g, or t
  misc_feature (6721)..(6721): n is a, c, g, or t
  misc_feature (6731)..(6731): n is a, c, g, or t
  misc_feature (6734)..(6734): n is a, c, g, or t
  misc_feature (6737)..(6737): n is a, c, g, or t
  misc_feature (6747)..(6747): n is a, c, g, or t
  misc_feature (6752)..(6752): n is a, c, g, or t
  misc_feature (6756)..(6756): n is a, c, g, or t
  misc_feature (6776)..(6776): n is a, c, g, or t
  misc_feature (6804)..(6804): n is a, c, g, or t
  misc_feature (6827)..(6827): n is a, c, g, or t
  misc_feature (6831)..(6831): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735219 - DNA, 7271 bp, Homo sapiens
  misc_feature (6488)..(6488): n is a, c, g, or t
  misc_feature (6495)..(6495): n is a, c, g, or t
  misc_feature (6515)..(6517): n is a, c, g, or t
  misc_feature (6523)..(6523): n is a, c, g, or t
  misc_feature (6528)..(6528): n is a, c, g, or t
  misc_feature (6537)..(6537): n is a, c, g, or t
  misc_feature (6540)..(6541): n is a, c, g, or t
  misc_feature (6546)..(6546): n is a, c, g, or t
  misc_feature (6564)..(6564): n is a, c, g, or t
  misc_feature (6570)..(6571): n is a, c, g, or t
  misc_feature (6576)..(6577): n is a, c, g, or t
  misc_feature (6582)..(6582): n is a, c, g, or t
  misc_feature (6584)..(6584): n is a, c, g, or t
  misc_feature (6599)..(6599): n is a, c, g, or t
  misc_feature (6603)..(6604): n is a, c, g, or t
  misc_feature (6606)..(6607): n is a, c, g, or t
  misc_feature (6613)..(6613): n is a, c, g, or t
  misc_feature (6616)..(6617): n is a, c, g, or t
  misc_feature (6619)..(6620): n is a, c, g, or t
  misc_feature (6623)..(6624): n is a, c, g, or t
  misc_feature (6629)..(6629): n is a, c, g, or t
  misc_feature (6637)..(6637): n is a, c, g, or t
  misc_feature (6639)..(6639): n is a, c, g, or t
  misc_feature (6642)..(6642): n is a, c, g, or t
  misc_feature (6644)..(6644): n is a, c, g, or t
  misc_feature (6646)..(6647): n is a, c, g, or t
  misc_feature (6654)..(6654): n is a, c, g, or t
  misc_feature (6657)..(6657): n is a, c, g, or t
  misc_feature (6659)..(6659): n is a, c, g, or t
  misc_feature (6674)..(6675): n is a, c, g, or t
  misc_feature (6682)..(6682): n is a, c, g, or t
  misc_feature (6685)..(6685): n is a, c, g, or t
  misc_feature (6692)..(6692): n is a, c, g, or t
  misc_feature (6697)..(6697): n is a, c, g, or t
  misc_feature (6700)..(6700): n is a, c, g, or t
  misc_feature (6704)..(6704): n is a, c, g, or t
  misc_feature (6707)..(6707): n is a, c, g, or t
  misc_feature (6711)..(6711): n is a, c, g, or t
  misc_feature (6714)..(6714): n is a, c, g, or t
  misc_feature (6717)..(6717): n is a, c, g, or t
  misc_feature (6721)..(6721): n is a, c, g, or t
  misc_feature (6731)..(6731): n is a, c, g, or t
  misc_feature (6734)..(6734): n is a, c, g, or t
  misc_feature (6737)..(6737): n is a, c, g, or t
  misc_feature (6747)..(6747): n is a, c, g, or t
  misc_feature (6752)..(6752): n is a, c, g, or t
  misc_feature (6756)..(6756): n is a, c, g, or t
  misc_feature (6776)..(6776): n is a, c, g, or t
  misc_feature (6804)..(6804): n is a, c, g, or t
  misc_feature (6827)..(6827): n is a, c, g, or t
  misc_feature (6831)..(6831): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735220 - DNA, 6414 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatccgtcgacgcggccgcgaattta

SEQ ID NO: 735221 - DNA, 7516 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735222 - DNA, 7217 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735223 - DNA, 7516 bp, Homo sapiens
  misc_feature (6434)..(6434): n is a, c, g, or t
  misc_feature (6441)..(6441): n is a, c, g, or t
  misc_feature (6461)..(6463): n is a, c, g, or t
  misc_feature (6469)..(6469): n is a, c, g, or t
  misc_feature (6474)..(6474): n is a, c, g, or t
  misc_feature (6483)..(6483): n is a, c, g, or t
  misc_feature (6486)..(6487): n is a, c, g, or t
  misc_feature (6492)..(6492): n is a, c, g, or t
  misc_feature (6510)..(6510): n is a, c, g, or t
  misc_feature (6516)..(6517): n is a, c, g, or t
  misc_feature (6522)..(6523): n is a, c, g, or t
  misc_feature (6528)..(6528): n is a, c, g, or t
  misc_feature (6530)..(6530): n is a, c, g, or t
  misc_feature (6545)..(6545): n is a, c, g, or t
  misc_feature (6549)..(6550): n is a, c, g, or t
  misc_feature (6552)..(6553): n is a, c, g, or t
  misc_feature (6559)..(6559): n is a, c, g, or t
  misc_feature (6562)..(6563): n is a, c, g, or t
  misc_feature (6565)..(6566): n is a, c, g, or t
  misc_feature (6569)..(6570): n is a, c, g, or t
  misc_feature (6575)..(6575): n is a, c, g, or t
  misc_feature (6583)..(6583): n is a, c, g, or t
  misc_feature (6585)..(6585): n is a, c, g, or t
  misc_feature (6588)..(6588): n is a, c, g, or t
  misc_feature (6590)..(6590): n is a, c, g, or t
  misc_feature (6592)..(6593): n is a, c, g, or t
  misc_feature (6600)..(6600): n is a, c, g, or t
  misc_feature (6603)..(6603): n is a, c, g, or t
  misc_feature (6605)..(6605): n is a, c, g, or t
  misc_feature (6620)..(6621): n is a, c, g, or t
  misc_feature (6628)..(6628): n is a, c, g, or t
  misc_feature (6631)..(6631): n is a, c, g, or t
  misc_feature (6638)..(6638): n is a, c, g, or t
  misc_feature (6643)..(6643): n is a, c, g, or t
  misc_feature (6646)..(6646): n is a, c, g, or t
  misc_feature (6650)..(6650): n is a, c, g, or t
  misc_feature (6653)..(6653): n is a, c, g, or t
  misc_feature (6657)..(6657): n is a, c, g, or t
  misc_feature (6660)..(6660): n is a, c, g, or t
  misc_feature (6663)..(6663): n is a, c, g, or t
  misc_feature (6667)..(6667): n is a, c, g, or t
  misc_feature (6677)..(6677): n is a, c, g, or t
  misc_feature (6680)..(6680): n is a, c, g, or t
  misc_feature (6683)..(6683): n is a, c, g, or t
  misc_feature (6693)..(6693): n is a, c, g, or t
  misc_feature (6698)..(6698): n is a, c, g, or t
  misc_feature (6702)..(6702): n is a, c, g, or t
  misc_feature (6722)..(6722): n is a, c, g, or t
  misc_feature (6750)..(6750): n is a, c, g, or t
  misc_feature (6773)..(6773): n is a, c, g, or t
  misc_feature (6777)..(6777): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735224 - DNA, 7217 bp, Homo sapiens
  misc_feature (6434)..(6434): n is a, c, g, or t
  misc_feature (6441)..(6441): n is a, c, g, or t
  misc_feature (6461)..(6463): n is a, c, g, or t
  misc_feature (6469)..(6469): n is a, c, g, or t
  misc_feature (6474)..(6474): n is a, c, g, or t
  misc_feature (6483)..(6483): n is a, c, g, or t
  misc_feature (6486)..(6487): n is a, c, g, or t
  misc_feature (6492)..(6492): n is a, c, g, or t
  misc_feature (6510)..(6510): n is a, c, g, or t
  misc_feature (6516)..(6517): n is a, c, g, or t
  misc_feature (6522)..(6523): n is a, c, g, or t
  misc_feature (6528)..(6528): n is a, c, g, or t
  misc_feature (6530)..(6530): n is a, c, g, or t
  misc_feature (6545)..(6545): n is a, c, g, or t
  misc_feature (6549)..(6550): n is a, c, g, or t
  misc_feature (6552)..(6553): n is a, c, g, or t
  misc_feature (6559)..(6559): n is a, c, g, or t
  misc_feature (6562)..(6563): n is a, c, g, or t
  misc_feature (6565)..(6566): n is a, c, g, or t
  misc_feature (6569)..(6570): n is a, c, g, or t
  misc_feature (6575)..(6575): n is a, c, g, or t
  misc_feature (6583)..(6583): n is a, c, g, or t
  misc_feature (6585)..(6585): n is a, c, g, or t
  misc_feature (6588)..(6588): n is a, c, g, or t
  misc_feature (6590)..(6590): n is a, c, g, or t
  misc_feature (6592)..(6593): n is a, c, g, or t
  misc_feature (6600)..(6600): n is a, c, g, or t
  misc_feature (6603)..(6603): n is a, c, g, or t
  misc_feature (6605)..(6605): n is a, c, g, or t
  misc_feature (6620)..(6621): n is a, c, g, or t
  misc_feature (6628)..(6628): n is a, c, g, or t
  misc_feature (6631)..(6631): n is a, c, g, or t
  misc_feature (6638)..(6638): n is a, c, g, or t
  misc_feature (6643)..(6643): n is a, c, g, or t
  misc_feature (6646)..(6646): n is a, c, g, or t
  misc_feature (6650)..(6650): n is a, c, g, or t
  misc_feature (6653)..(6653): n is a, c, g, or t
  misc_feature (6657)..(6657): n is a, c, g, or t
  misc_feature (6660)..(6660): n is a, c, g, or t
  misc_feature (6663)..(6663): n is a, c, g, or t
  misc_feature (6667)..(6667): n is a, c, g, or t
  misc_feature (6677)..(6677): n is a, c, g, or t
  misc_feature (6680)..(6680): n is a, c, g, or t
  misc_feature (6683)..(6683): n is a, c, g, or t
  misc_feature (6693)..(6693): n is a, c, g, or t
  misc_feature (6698)..(6698): n is a, c, g, or t
  misc_feature (6702)..(6702): n is a, c, g, or t
  misc_feature (6722)..(6722): n is a, c, g, or t
  misc_feature (6750)..(6750): n is a, c, g, or t
  misc_feature (6773)..(6773): n is a, c, g, or t
  misc_feature (6777)..(6777): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735225 - DNA, 6360 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatccgtcgacgcggccgcgaattta

SEQ ID NO: 735226 - DNA, 6356 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735227 - DNA, 6057 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735228 - DNA, 6755 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735229 - DNA, 6456 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735230 - DNA, 6755 bp, Homo sapiens
  misc_feature (5673)..(5673): n is a, c, g, or t
  misc_feature (5680)..(5680): n is a, c, g, or t
  misc_feature (5700)..(5702): n is a, c, g, or t
  misc_feature (5708)..(5708): n is a, c, g, or t
  misc_feature (5713)..(5713): n is a, c, g, or t
  misc_feature (5722)..(5722): n is a, c, g, or t
  misc_feature (5725)..(5726): n is a, c, g, or t
  misc_feature (5731)..(5731): n is a, c, g, or t
  misc_feature (5749)..(5749): n is a, c, g, or t
  misc_feature (5755)..(5756): n is a, c, g, or t
  misc_feature (5761)..(5762): n is a, c, g, or t
  misc_feature (5767)..(5767): n is a, c, g, or t
  misc_feature (5769)..(5769): n is a, c, g, or t
  misc_feature (5784)..(5784): n is a, c, g, or t
  misc_feature (5788)..(5789): n is a, c, g, or t
  misc_feature (5791)..(5792): n is a, c, g, or t
  misc_feature (5798)..(5798): n is a, c, g, or t
  misc_feature (5801)..(5802): n is a, c, g, or t
  misc_feature (5804)..(5805): n is a, c, g, or t
  misc_feature (5808)..(5809): n is a, c, g, or t
  misc_feature (5814)..(5814): n is a, c, g, or t
  misc_feature (5822)..(5822): n is a, c, g, or t
  misc_feature (5824)..(5824): n is a, c, g, or t
  misc_feature (5827)..(5827): n is a, c, g, or t
  misc_feature (5829)..(5829): n is a, c, g, or t
  misc_feature (5831)..(5832): n is a, c, g, or t
  misc_feature (5839)..(5839): n is a, c, g, or t
  misc_feature (5842)..(5842): n is a, c, g, or t
  misc_feature (5844)..(5844): n is a, c, g, or t
  misc_feature (5859)..(5860): n is a, c, g, or t
  misc_feature (5867)..(5867): n is a, c, g, or t
  misc_feature (5870)..(5870): n is a, c, g, or t
  misc_feature (5877)..(5877): n is a, c, g, or t
  misc_feature (5882)..(5882): n is a, c, g, or t
  misc_feature (5885)..(5885): n is a, c, g, or t
  misc_feature (5889)..(5889): n is a, c, g, or t
  misc_feature (5892)..(5892): n is a, c, g, or t
  misc_feature (5896)..(5896): n is a, c, g, or t
  misc_feature (5899)..(5899): n is a, c, g, or t
  misc_feature (5902)..(5902): n is a, c, g, or t
  misc_feature (5906)..(5906): n is a, c, g, or t
  misc_feature (5916)..(5916): n is a, c, g, or t
  misc_feature (5919)..(5919): n is a, c, g, or t
  misc_feature (5922)..(5922): n is a, c, g, or t
  misc_feature (5932)..(5932): n is a, c, g, or t
  misc_feature (5937)..(5937): n is a, c, g, or t
  misc_feature (5941)..(5941): n is a, c, g, or t
  misc_feature (5961)..(5961): n is a, c, g, or t
  misc_feature (5989)..(5989): n is a, c, g, or t
  misc_feature (6012)..(6012): n is a, c, g, or t
  misc_feature (6016)..(6016): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735231 - DNA, 6456 bp, Homo sapiens
  misc_feature (5673)..(5673): n is a, c, g, or t
  misc_feature (5680)..(5680): n is a, c, g, or t
  misc_feature (5700)..(5702): n is a, c, g, or t
  misc_feature (5708)..(5708): n is a, c, g, or t
  misc_feature (5713)..(5713): n is a, c, g, or t
  misc_feature (5722)..(5722): n is a, c, g, or t
  misc_feature (5725)..(5726): n is a, c, g, or t
  misc_feature (5731)..(5731): n is a, c, g, or t
  misc_feature (5749)..(5749): n is a, c, g, or t
  misc_feature (5755)..(5756): n is a, c, g, or t
  misc_feature (5761)..(5762): n is a, c, g, or t
  misc_feature (5767)..(5767): n is a, c, g, or t
  misc_feature (5769)..(5769): n is a, c, g, or t
  misc_feature (5784)..(5784): n is a, c, g, or t
  misc_feature (5788)..(5789): n is a, c, g, or t
  misc_feature (5791)..(5792): n is a, c, g, or t
  misc_feature (5798)..(5798): n is a, c, g, or t
  misc_feature (5801)..(5802): n is a, c, g, or t
  misc_feature (5804)..(5805): n is a, c, g, or t
  misc_feature (5808)..(5809): n is a, c, g, or t
  misc_feature (5814)..(5814): n is a, c, g, or t
  misc_feature (5822)..(5822): n is a, c, g, or t
  misc_feature (5824)..(5824): n is a, c, g, or t
  misc_feature (5827)..(5827): n is a, c, g, or t
  misc_feature (5829)..(5829): n is a, c, g, or t
  misc_feature (5831)..(5832): n is a, c, g, or t
  misc_feature (5839)..(5839): n is a, c, g, or t
  misc_feature (5842)..(5842): n is a, c, g, or t
  misc_feature (5844)..(5844): n is a, c, g, or t
  misc_feature (5859)..(5860): n is a, c, g, or t
  misc_feature (5867)..(5867): n is a, c, g, or t
  misc_feature (5870)..(5870): n is a, c, g, or t
  misc_feature (5877)..(5877): n is a, c, g, or t
  misc_feature (5882)..(5882): n is a, c, g, or t
  misc_feature (5885)..(5885): n is a, c, g, or t
  misc_feature (5889)..(5889): n is a, c, g, or t
  misc_feature (5892)..(5892): n is a, c, g, or t
  misc_feature (5896)..(5896): n is a, c, g, or t
  misc_feature (5899)..(5899): n is a, c, g, or t
  misc_feature (5902)..(5902): n is a, c, g, or t
  misc_feature (5906)..(5906): n is a, c, g, or t
  misc_feature (5916)..(5916): n is a, c, g, or t
  misc_feature (5919)..(5919): n is a, c, g, or t
  misc_feature (5922)..(5922): n is a, c, g, or t
  misc_feature (5932)..(5932): n is a, c, g, or t
  misc_feature (5937)..(5937): n is a, c, g, or t
  misc_feature (5941)..(5941): n is a, c, g, or t
  misc_feature (5961)..(5961): n is a, c, g, or t
  misc_feature (5989)..(5989): n is a, c, g, or t
  misc_feature (6012)..(6012): n is a, c, g, or t
  misc_feature (6016)..(6016): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735232 - DNA, 5599 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatccgtcgacgcggccgcgaattta

SEQ ID NO: 735233 - DNA, 6701 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735234 - DNA, 6402 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735235 - DNA, 6701 bp, Homo sapiens
  misc_feature (5619)..(5619): n is a, c, g, or t
  misc_feature (5626)..(5626): n is a, c, g, or t
  misc_feature (5646)..(5648): n is a, c, g, or t
  misc_feature (5654)..(5654): n is a, c, g, or t
  misc_feature (5659)..(5659): n is a, c, g, or t
  misc_feature (5668)..(5668): n is a, c, g, or t
  misc_feature (5671)..(5672): n is a, c, g, or t
  misc_feature (5677)..(5677): n is a, c, g, or t
  misc_feature (5695)..(5695): n is a, c, g, or t
  misc_feature (5701)..(5702): n is a, c, g, or t
  misc_feature (5707)..(5708): n is a, c, g, or t
  misc_feature (5713)..(5713): n is a, c, g, or t
  misc_feature (5715)..(5715): n is a, c, g, or t
  misc_feature (5730)..(5730): n is a, c, g, or t
  misc_feature (5734)..(5735): n is a, c, g, or t
  misc_feature (5737)..(5738): n is a, c, g, or t
  misc_feature (5744)..(5744): n is a, c, g, or t
  misc_feature (5747)..(5748): n is a, c, g, or t
  misc_feature (5750)..(5751): n is a, c, g, or t
  misc_feature (5754)..(5755): n is a, c, g, or t
  misc_feature (5760)..(5760): n is a, c, g, or t
  misc_feature (5768)..(5768): n is a, c, g, or t
  misc_feature (5770)..(5770): n is a, c, g, or t
  misc_feature (5773)..(5773): n is a, c, g, or t
  misc_feature (5775)..(5775): n is a, c, g, or t
  misc_feature (5777)..(5778): n is a, c, g, or t
  misc_feature (5785)..(5785): n is a, c, g, or t
  misc_feature (5788)..(5788): n is a, c, g, or t
  misc_feature (5790)..(5790): n is a, c, g, or t
  misc_feature (5805)..(5806): n is a, c, g, or t
  misc_feature (5813)..(5813): n is a, c, g, or t
  misc_feature (5816)..(5816): n is a, c, g, or t
  misc_feature (5823)..(5823): n is a, c, g, or t
  misc_feature (5828)..(5828): n is a, c, g, or t
  misc_feature (5831)..(5831): n is a, c, g, or t
  misc_feature (5835)..(5835): n is a, c, g, or t
  misc_feature (5838)..(5838): n is a, c, g, or t
  misc_feature (5842)..(5842): n is a, c, g, or t
  misc_feature (5845)..(5845): n is a, c, g, or t
  misc_feature (5848)..(5848): n is a, c, g, or t
  misc_feature (5852)..(5852): n is a, c, g, or t
  misc_feature (5862)..(5862): n is a, c, g, or t
  misc_feature (5865)..(5865): n is a, c, g, or t
  misc_feature (5868)..(5868): n is a, c, g, or t
  misc_feature (5878)..(5878): n is a, c, g, or t
  misc_feature (5883)..(5883): n is a, c, g, or t
  misc_feature (5887)..(5887): n is a, c, g, or t
  misc_feature (5907)..(5907): n is a, c, g, or t
  misc_feature (5935)..(5935): n is a, c, g, or t
  misc_feature (5958)..(5958): n is a, c, g, or t
  misc_feature (5962)..(5962): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735236 - DNA, 6402 bp, Homo sapiens
  misc_feature (5619)..(5619): n is a, c, g, or t
  misc_feature (5626)..(5626): n is a, c, g, or t
  misc_feature (5646)..(5648): n is a, c, g, or t
  misc_feature (5654)..(5654): n is a, c, g, or t
  misc_feature (5659)..(5659): n is a, c, g, or t
  misc_feature (5668)..(5668): n is a, c, g, or t
  misc_feature (5671)..(5672): n is a, c, g, or t
  misc_feature (5677)..(5677): n is a, c, g, or t
  misc_feature (5695)..(5695): n is a, c, g, or t
  misc_feature (5701)..(5702): n is a, c, g, or t
  misc_feature (5707)..(5708): n is a, c, g, or t
  misc_feature (5713)..(5713): n is a, c, g, or t
  misc_feature (5715)..(5715): n is a, c, g, or t
  misc_feature (5730)..(5730): n is a, c, g, or t
  misc_feature (5734)..(5735): n is a, c, g, or t
  misc_feature (5737)..(5738): n is a, c, g, or t
  misc_feature (5744)..(5744): n is a, c, g, or t
  misc_feature (5747)..(5748): n is a, c, g, or t
  misc_feature (5750)..(5751): n is a, c, g, or t
  misc_feature (5754)..(5755): n is a, c, g, or t
  misc_feature (5760)..(5760): n is a, c, g, or t
  misc_feature (5768)..(5768): n is a, c, g, or t
  misc_feature (5770)..(5770): n is a, c, g, or t
  misc_feature (5773)..(5773): n is a, c, g, or t
  misc_feature (5775)..(5775): n is a, c, g, or t
  misc_feature (5777)..(5778): n is a, c, g, or t
  misc_feature (5785)..(5785): n is a, c, g, or t
  misc_feature (5788)..(5788): n is a, c, g, or t
  misc_feature (5790)..(5790): n is a, c, g, or t
  misc_feature (5805)..(5806): n is a, c, g, or t
  misc_feature (5813)..(5813): n is a, c, g, or t
  misc_feature (5816)..(5816): n is a, c, g, or t
  misc_feature (5823)..(5823): n is a, c, g, or t
  misc_feature (5828)..(5828): n is a, c, g, or t
  misc_feature (5831)..(5831): n is a, c, g, or t
  misc_feature (5835)..(5835): n is a, c, g, or t
  misc_feature (5838)..(5838): n is a, c, g, or t
  misc_feature (5842)..(5842): n is a, c, g, or t
  misc_feature (5845)..(5845): n is a, c, g, or t
  misc_feature (5848)..(5848): n is a, c, g, or t
  misc_feature (5852)..(5852): n is a, c, g, or t
  misc_feature (5862)..(5862): n is a, c, g, or t
  misc_feature (5865)..(5865): n is a, c, g, or t
  misc_feature (5868)..(5868): n is a, c, g, or t
  misc_feature (5878)..(5878): n is a, c, g, or t
  misc_feature (5883)..(5883): n is a, c, g, or t
  misc_feature (5887)..(5887): n is a, c, g, or t
  misc_feature (5907)..(5907): n is a, c, g, or t
  misc_feature (5935)..(5935): n is a, c, g, or t
  misc_feature (5958)..(5958): n is a, c, g, or t
  misc_feature (5962)..(5962): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735237 - DNA, 5545 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatccgtcgacgcggccgcgaattta

SEQ ID NO: 735238 - DNA, 5541 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735239 - DNA, 5242 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735240 - DNA, 7686 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735241 - DNA, 7387 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735242 - DNA, 7686 bp, Homo sapiens
  misc_feature (6604)..(6604): n is a, c, g, or t
  misc_feature (6611)..(6611): n is a, c, g, or t
  misc_feature (6631)..(6633): n is a, c, g, or t
  misc_feature (6639)..(6639): n is a, c, g, or t
  misc_feature (6644)..(6644): n is a, c, g, or t
  misc_feature (6653)..(6653): n is a, c, g, or t
  misc_feature (6656)..(6657): n is a, c, g, or t
  misc_feature (6662)..(6662): n is a, c, g, or t
  misc_feature (6680)..(6680): n is a, c, g, or t
  misc_feature (6686)..(6687): n is a, c, g, or t
  misc_feature (6692)..(6693): n is a, c, g, or t
  misc_feature (6698)..(6698): n is a, c, g, or t
  misc_feature (6700)..(6700): n is a, c, g, or t
  misc_feature (6715)..(6715): n is a, c, g, or t
  misc_feature (6719)..(6720): n is a, c, g, or t
  misc_feature (6722)..(6723): n is a, c, g, or t
  misc_feature (6729)..(6729): n is a, c, g, or t
  misc_feature (6732)..(6733): n is a, c, g, or t
  misc_feature (6735)..(6736): n is a, c, g, or t
  misc_feature (6739)..(6740): n is a, c, g, or t
  misc_feature (6745)..(6745): n is a, c, g, or t
  misc_feature (6753)..(6753): n is a, c, g, or t
  misc_feature (6755)..(6755): n is a, c, g, or t
  misc_feature (6758)..(6758): n is a, c, g, or t
  misc_feature (6760)..(6760): n is a, c, g, or t
  misc_feature (6762)..(6763): n is a, c, g, or t
  misc_feature (6770)..(6770): n is a, c, g, or t
  misc_feature (6773)..(6773): n is a, c, g, or t
  misc_feature (6775)..(6775): n is a, c, g, or t
  misc_feature (6790)..(6791): n is a, c, g, or t
  misc_feature (6798)..(6798): n is a, c, g, or t
  misc_feature (6801)..(6801): n is a, c, g, or t
  misc_feature (6808)..(6808): n is a, c, g, or t
  misc_feature (6813)..(6813): n is a, c, g, or t
  misc_feature (6816)..(6816): n is a, c, g, or t
  misc_feature (6820)..(6820): n is a, c, g, or t
  misc_feature (6823)..(6823): n is a, c, g, or t
  misc_feature (6827)..(6827): n is a, c, g, or t
  misc_feature (6830)..(6830): n is a, c, g, or t
  misc_feature (6833)..(6833): n is a, c, g, or t
  misc_feature (6837)..(6837): n is a, c, g, or t
  misc_feature (6847)..(6847): n is a, c, g, or t
  misc_feature (6850)..(6850): n is a, c, g, or t
  misc_feature (6853)..(6853): n is a, c, g, or t
  misc_feature (6863)..(6863): n is a, c, g, or t
  misc_feature (6868)..(6868): n is a, c, g, or t
  misc_feature (6872)..(6872): n is a, c, g, or t
  misc_feature (6892)..(6892): n is a, c, g, or t
  misc_feature (6920)..(6920): n is a, c, g, or t
  misc_feature (6943)..(6943): n is a, c, g, or t
  misc_feature (6947)..(6947): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735243 - DNA, 7387 bp, Homo sapiens
  misc_feature (6604)..(6604): n is a, c, g, or t
  misc_feature (6611)..(6611): n is a, c, g, or t
  misc_feature (6631)..(6633): n is a, c, g, or t
  misc_feature (6639)..(6639): n is a, c, g, or t
  misc_feature (6644)..(6644): n is a, c, g, or t
  misc_feature (6653)..(6653): n is a, c, g, or t
  misc_feature (6656)..(6657): n is a, c, g, or t
  misc_feature (6662)..(6662): n is a, c, g, or t
  misc_feature (6680)..(6680): n is a, c, g, or t
  misc_feature (6686)..(6687): n is a, c, g, or t
  misc_feature (6692)..(6693): n is a, c, g, or t
  misc_feature (6698)..(6698): n is a, c, g, or t
  misc_feature (6700)..(6700): n is a, c, g, or t
  misc_feature (6715)..(6715): n is a, c, g, or t
  misc_feature (6719)..(6720): n is a, c, g, or t
  misc_feature (6722)..(6723): n is a, c, g, or t
  misc_feature (6729)..(6729): n is a, c, g, or t
  misc_feature (6732)..(6733): n is a, c, g, or t
  misc_feature (6735)..(6736): n is a, c, g, or t
  misc_feature (6739)..(6740): n is a, c, g, or t
  misc_feature (6745)..(6745): n is a, c, g, or t
  misc_feature (6753)..(6753): n is a, c, g, or t
  misc_feature (6755)..(6755): n is a, c, g, or t
  misc_feature (6758)..(6758): n is a, c, g, or t
  misc_feature (6760)..(6760): n is a, c, g, or t
  misc_feature (6762)..(6763): n is a, c, g, or t
  misc_feature (6770)..(6770): n is a, c, g, or t
  misc_feature (6773)..(6773): n is a, c, g, or t
  misc_feature (6775)..(6775): n is a, c, g, or t
  misc_feature (6790)..(6791): n is a, c, g, or t
  misc_feature (6798)..(6798): n is a, c, g, or t
  misc_feature (6801)..(6801): n is a, c, g, or t
  misc_feature (6808)..(6808): n is a, c, g, or t
  misc_feature (6813)..(6813): n is a, c, g, or t
  misc_feature (6816)..(6816): n is a, c, g, or t
  misc_feature (6820)..(6820): n is a, c, g, or t
  misc_feature (6823)..(6823): n is a, c, g, or t
  misc_feature (6827)..(6827): n is a, c, g, or t
  misc_feature (6830)..(6830): n is a, c, g, or t
  misc_feature (6833)..(6833): n is a, c, g, or t
  misc_feature (6837)..(6837): n is a, c, g, or t
  misc_feature (6847)..(6847): n is a, c, g, or t
  misc_feature (6850)..(6850): n is a, c, g, or t
  misc_feature (6853)..(6853): n is a, c, g, or t
  misc_feature (6863)..(6863): n is a, c, g, or t
  misc_feature (6868)..(6868): n is a, c, g, or t
  misc_feature (6872)..(6872): n is a, c, g, or t
  misc_feature (6892)..(6892): n is a, c, g, or t
  misc_feature (6920)..(6920): n is a, c, g, or t
  misc_feature (6943)..(6943): n is a, c, g, or t
  misc_feature (6947)..(6947): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735244 - DNA, 6530 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatccgtcgacgcggccgcgaattta

SEQ ID NO: 735245 - DNA, 7632 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735246 - DNA, 7333 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735247 - DNA, 7632 bp, Homo sapiens
  misc_feature (6550)..(6550): n is a, c, g, or t
  misc_feature (6557)..(6557): n is a, c, g, or t
  misc_feature (6577)..(6579): n is a, c, g, or t
  misc_feature (6585)..(6585): n is a, c, g, or t
  misc_feature (6590)..(6590): n is a, c, g, or t
  misc_feature (6599)..(6599): n is a, c, g, or t
  misc_feature (6602)..(6603): n is a, c, g, or t
  misc_feature (6608)..(6608): n is a, c, g, or t
  misc_feature (6626)..(6626): n is a, c, g, or t
  misc_feature (6632)..(6633): n is a, c, g, or t
  misc_feature (6638)..(6639): n is a, c, g, or t
  misc_feature (6644)..(6644): n is a, c, g, or t
  misc_feature (6646)..(6646): n is a, c, g, or t
  misc_feature (6661)..(6661): n is a, c, g, or t
  misc_feature (6665)..(6666): n is a, c, g, or t
  misc_feature (6668)..(6669): n is a, c, g, or t
  misc_feature (6675)..(6675): n is a, c, g, or t
  misc_feature (6678)..(6679): n is a, c, g, or t
  misc_feature (6681)..(6682): n is a, c, g, or t
  misc_feature (6685)..(6686): n is a, c, g, or t
  misc_feature (6691)..(6691): n is a, c, g, or t
  misc_feature (6699)..(6699): n is a, c, g, or t
  misc_feature (6701)..(6701): n is a, c, g, or t
  misc_feature (6704)..(6704): n is a, c, g, or t
  misc_feature (6706)..(6706): n is a, c, g, or t
  misc_feature (6708)..(6709): n is a, c, g, or t
  misc_feature (6716)..(6716): n is a, c, g, or t
  misc_feature (6719)..(6719): n is a, c, g, or t
  misc_feature (6721)..(6721): n is a, c, g, or t
  misc_feature (6736)..(6737): n is a, c, g, or t
  misc_feature (6744)..(6744): n is a, c, g, or t
  misc_feature (6747)..(6747): n is a, c, g, or t
  misc_feature (6754)..(6754): n is a, c, g, or t
  misc_feature (6759)..(6759): n is a, c, g, or t
  misc_feature (6762)..(6762): n is a, c, g, or t
  misc_feature (6766)..(6766): n is a, c, g, or t
  misc_feature (6769)..(6769): n is a, c, g, or t
  misc_feature (6773)..(6773): n is a, c, g, or t
  misc_feature (6776)..(6776): n is a, c, g, or t
  misc_feature (6779)..(6779): n is a, c, g, or t
  misc_feature (6783)..(6783): n is a, c, g, or t
  misc_feature (6793)..(6793): n is a, c, g, or t
  misc_feature (6796)..(6796): n is a, c, g, or t
  misc_feature (6799)..(6799): n is a, c, g, or t
  misc_feature (6809)..(6809): n is a, c, g, or t
  misc_feature (6814)..(6814): n is a, c, g, or t
  misc_feature (6818)..(6818): n is a, c, g, or t
  misc_feature (6838)..(6838): n is a, c, g, or t
  misc_feature (6866)..(6866): n is a, c, g, or t
  misc_feature (6889)..(6889): n is a, c, g, or t
  misc_feature (6893)..(6893): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735248 - DNA, 7333 bp, Homo sapiens
  misc_feature (6550)..(6550): n is a, c, g, or t
  misc_feature (6557)..(6557): n is a, c, g, or t
  misc_feature (6577)..(6579): n is a, c, g, or t
  misc_feature (6585)..(6585): n is a, c, g, or t
  misc_feature (6590)..(6590): n is a, c, g, or t
  misc_feature (6599)..(6599): n is a, c, g, or t
  misc_feature (6602)..(6603): n is a, c, g, or t
  misc_feature (6608)..(6608): n is a, c, g, or t
  misc_feature (6626)..(6626): n is a, c, g, or t
  misc_feature (6632)..(6633): n is a, c, g, or t
  misc_feature (6638)..(6639): n is a, c, g, or t
  misc_feature (6644)..(6644): n is a, c, g, or t
  misc_feature (6646)..(6646): n is a, c, g, or t
  misc_feature (6661)..(6661): n is a, c, g, or t
  misc_feature (6665)..(6666): n is a, c, g, or t
  misc_feature (6668)..(6669): n is a, c, g, or t
  misc_feature (6675)..(6675): n is a, c, g, or t
  misc_feature (6678)..(6679): n is a, c, g, or t
  misc_feature (6681)..(6682): n is a, c, g, or t
  misc_feature (6685)..(6686): n is a, c, g, or t
  misc_feature (6691)..(6691): n is a, c, g, or t
  misc_feature (6699)..(6699): n is a, c, g, or t
  misc_feature (6701)..(6701): n is a, c, g, or t
  misc_feature (6704)..(6704): n is a, c, g, or t
  misc_feature (6706)..(6706): n is a, c, g, or t
  misc_feature (6708)..(6709): n is a, c, g, or t
  misc_feature (6716)..(6716): n is a, c, g, or t
  misc_feature (6719)..(6719): n is a, c, g, or t
  misc_feature (6721)..(6721): n is a, c, g, or t
  misc_feature (6736)..(6737): n is a, c, g, or t
  misc_feature (6744)..(6744): n is a, c, g, or t
  misc_feature (6747)..(6747): n is a, c, g, or t
  misc_feature (6754)..(6754): n is a, c, g, or t
  misc_feature (6759)..(6759): n is a, c, g, or t
  misc_feature (6762)..(6762): n is a, c, g, or t
  misc_feature (6766)..(6766): n is a, c, g, or t
  misc_feature (6769)..(6769): n is a, c, g, or t
  misc_feature (6773)..(6773): n is a, c, g, or t
  misc_feature (6776)..(6776): n is a, c, g, or t
  misc_feature (6779)..(6779): n is a, c, g, or t
  misc_feature (6783)..(6783): n is a, c, g, or t
  misc_feature (6793)..(6793): n is a, c, g, or t
  misc_feature (6796)..(6796): n is a, c, g, or t
  misc_feature (6799)..(6799): n is a, c, g, or t
  misc_feature (6809)..(6809): n is a, c, g, or t
  misc_feature (6814)..(6814): n is a, c, g, or t
  misc_feature (6818)..(6818): n is a, c, g, or t
  misc_feature (6838)..(6838): n is a, c, g, or t
  misc_feature (6866)..(6866): n is a, c, g, or t
  misc_feature (6889)..(6889): n is a, c, g, or t
  misc_feature (6893)..(6893): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735249 - DNA, 6476 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatccgtcgacgcggccgcgaattta

SEQ ID NO: 735250 - DNA, 6472 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735251 - DNA, 6173 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735252 - DNA, 6871 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735253 - DNA, 6572 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735254 - DNA, 6871 bp, Homo sapiens
  misc_feature (5789)..(5789): n is a, c, g, or t
  misc_feature (5796)..(5796): n is a, c, g, or t
  misc_feature (5816)..(5818): n is a, c, g, or t
  misc_feature (5824)..(5824): n is a, c, g, or t
  misc_feature (5829)..(5829): n is a, c, g, or t
  misc_feature (5838)..(5838): n is a, c, g, or t
  misc_feature (5841)..(5842): n is a, c, g, or t
  misc_feature (5847)..(5847): n is a, c, g, or t
  misc_feature (5865)..(5865): n is a, c, g, or t
  misc_feature (5871)..(5872): n is a, c, g, or t
  misc_feature (5877)..(5878): n is a, c, g, or t
  misc_feature (5883)..(5883): n is a, c, g, or t
  misc_feature (5885)..(5885): n is a, c, g, or t
  misc_feature (5900)..(5900): n is a, c, g, or t
  misc_feature (5904)..(5905): n is a, c, g, or t
  misc_feature (5907)..(5908): n is a, c, g, or t
  misc_feature (5914)..(5914): n is a, c, g, or t
  misc_feature (5917)..(5918): n is a, c, g, or t
  misc_feature (5920)..(5921): n is a, c, g, or t
  misc_feature (5924)..(5925): n is a, c, g, or t
  misc_feature (5930)..(5930): n is a, c, g, or t
  misc_feature (5938)..(5938): n is a, c, g, or t
  misc_feature (5940)..(5940): n is a, c, g, or t
  misc_feature (5943)..(5943): n is a, c, g, or t
  misc_feature (5945)..(5945): n is a, c, g, or t
  misc_feature (5947)..(5948): n is a, c, g, or t
  misc_feature (5955)..(5955): n is a, c, g, or t
  misc_feature (5958)..(5958): n is a, c, g, or t
  misc_feature (5960)..(5960): n is a, c, g, or t
  misc_feature (5975)..(5976): n is a, c, g, or t
  misc_feature (5983)..(5983): n is a, c, g, or t
  misc_feature (5986)..(5986): n is a, c, g, or t
  misc_feature (5993)..(5993): n is a, c, g, or t
  misc_feature (5998)..(5998): n is a, c, g, or t
  misc_feature (6001)..(6001): n is a, c, g, or t
  misc_feature (6005)..(6005): n is a, c, g, or t
  misc_feature (6008)..(6008): n is a, c, g, or t
  misc_feature (6012)..(6012): n is a, c, g, or t
  misc_feature (6015)..(6015): n is a, c, g, or t
  misc_feature (6018)..(6018): n is a, c, g, or t
  misc_feature (6022)..(6022): n is a, c, g, or t
  misc_feature (6032)..(6032): n is a, c, g, or t
  misc_feature (6035)..(6035): n is a, c, g, or t
  misc_feature (6038)..(6038): n is a, c, g, or t
  misc_feature (6048)..(6048): n is a, c, g, or t
  misc_feature (6053)..(6053): n is a, c, g, or t
  misc_feature (6057)..(6057): n is a, c, g, or t
  misc_feature (6077)..(6077): n is a, c, g, or t
  misc_feature (6105)..(6105): n is a, c, g, or t
  misc_feature (6128)..(6128): n is a, c, g, or t
  misc_feature (6132)..(6132): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735255 - DNA, 6572 bp, Homo sapiens
  misc_feature (5789)..(5789): n is a, c, g, or t
  misc_feature (5796)..(5796): n is a, c, g, or t
  misc_feature (5816)..(5818): n is a, c, g, or t
  misc_feature (5824)..(5824): n is a, c, g, or t
  misc_feature (5829)..(5829): n is a, c, g, or t
  misc_feature (5838)..(5838): n is a, c, g, or t
  misc_feature (5841)..(5842): n is a, c, g, or t
  misc_feature (5847)..(5847): n is a, c, g, or t
  misc_feature (5865)..(5865): n is a, c, g, or t
  misc_feature (5871)..(5872): n is a, c, g, or t
  misc_feature (5877)..(5878): n is a, c, g, or t
  misc_feature (5883)..(5883): n is a, c, g, or t
  misc_feature (5885)..(5885): n is a, c, g, or t
  misc_feature (5900)..(5900): n is a, c, g, or t
  misc_feature (5904)..(5905): n is a, c, g, or t
  misc_feature (5907)..(5908): n is a, c, g, or t
  misc_feature (5914)..(5914): n is a, c, g, or t
  misc_feature (5917)..(5918): n is a, c, g, or t
  misc_feature (5920)..(5921): n is a, c, g, or t
  misc_feature (5924)..(5925): n is a, c, g, or t
  misc_feature (5930)..(5930): n is a, c, g, or t
  misc_feature (5938)..(5938): n is a, c, g, or t
  misc_feature (5940)..(5940): n is a, c, g, or t
  misc_feature (5943)..(5943): n is a, c, g, or t
  misc_feature (5945)..(5945): n is a, c, g, or t
  misc_feature (5947)..(5948): n is a, c, g, or t
  misc_feature (5955)..(5955): n is a, c, g, or t
  misc_feature (5958)..(5958): n is a, c, g, or t
  misc_feature (5960)..(5960): n is a, c, g, or t
  misc_feature (5975)..(5976): n is a, c, g, or t
  misc_feature (5983)..(5983): n is a, c, g, or t
  misc_feature (5986)..(5986): n is a, c, g, or t
  misc_feature (5993)..(5993): n is a, c, g, or t
  misc_feature (5998)..(5998): n is a, c, g, or t
  misc_feature (6001)..(6001): n is a, c, g, or t
  misc_feature (6005)..(6005): n is a, c, g, or t
  misc_feature (6008)..(6008): n is a, c, g, or t
  misc_feature (6012)..(6012): n is a, c, g, or t
  misc_feature (6015)..(6015): n is a, c, g, or t
  misc_feature (6018)..(6018): n is a, c, g, or t
  misc_feature (6022)..(6022): n is a, c, g, or t
  misc_feature (6032)..(6032): n is a, c, g, or t
  misc_feature (6035)..(6035): n is a, c, g, or t
  misc_feature (6038)..(6038): n is a, c, g, or t
  misc_feature (6048)..(6048): n is a, c, g, or t
  misc_feature (6053)..(6053): n is a, c, g, or t
  misc_feature (6057)..(6057): n is a, c, g, or t
  misc_feature (6077)..(6077): n is a, c, g, or t
  misc_feature (6105)..(6105): n is a, c, g, or t
  misc_feature (6128)..(6128): n is a, c, g, or t
  misc_feature (6132)..(6132): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735256 - DNA, 5715 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatccgtcgacgcggccgcgaattta

SEQ ID NO: 735257 - DNA, 6817 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735258 - DNA, 6518 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735259 - DNA, 6817 bp, Homo sapiens
  misc_feature (5735)..(5735): n is a, c, g, or t
  misc_feature (5742)..(5742): n is a, c, g, or t
  misc_feature (5762)..(5764): n is a, c, g, or t
  misc_feature (5770)..(5770): n is a, c, g, or t
  misc_feature (5775)..(5775): n is a, c, g, or t
  misc_feature (5784)..(5784): n is a, c, g, or t
  misc_feature (5787)..(5788): n is a, c, g, or t
  misc_feature (5793)..(5793): n is a, c, g, or t
  misc_feature (5811)..(5811): n is a, c, g, or t
  misc_feature (5817)..(5818): n is a, c, g, or t
  misc_feature (5823)..(5824): n is a, c, g, or t
  misc_feature (5829)..(5829): n is a, c, g, or t
  misc_feature (5831)..(5831): n is a, c, g, or t
  misc_feature (5846)..(5846): n is a, c, g, or t
  misc_feature (5850)..(5851): n is a, c, g, or t
  misc_feature (5853)..(5854): n is a, c, g, or t
  misc_feature (5860)..(5860): n is a, c, g, or t
  misc_feature (5863)..(5864): n is a, c, g, or t
  misc_feature (5866)..(5867): n is a, c, g, or t
  misc_feature (5870)..(5871): n is a, c, g, or t
  misc_feature (5876)..(5876): n is a, c, g, or t
  misc_feature (5884)..(5884): n is a, c, g, or t
  misc_feature (5886)..(5886): n is a, c, g, or t
  misc_feature (5889)..(5889): n is a, c, g, or t
  misc_feature (5891)..(5891): n is a, c, g, or t
  misc_feature (5893)..(5894): n is a, c, g, or t
  misc_feature (5901)..(5901): n is a, c, g, or t
  misc_feature (5904)..(5904): n is a, c, g, or t
  misc_feature (5906)..(5906): n is a, c, g, or t
  misc_feature (5921)..(5922): n is a, c, g, or t
  misc_feature (5929)..(5929): n is a, c, g, or t
  misc_feature (5932)..(5932): n is a, c, g, or t
  misc_feature (5939)..(5939): n is a, c, g, or t
  misc_feature (5944)..(5944): n is a, c, g, or t
  misc_feature (5947)..(5947): n is a, c, g, or t
  misc_feature (5951)..(5951): n is a, c, g, or t
  misc_feature (5954)..(5954): n is a, c, g, or t
  misc_feature (5958)..(5958): n is a, c, g, or t
  misc_feature (5961)..(5961): n is a, c, g, or t
  misc_feature (5964)..(5964): n is a, c, g, or t
  misc_feature (5968)..(5968): n is a, c, g, or t
  misc_feature (5978)..(5978): n is a, c, g, or t
  misc_feature (5981)..(5981): n is a, c, g, or t
  misc_feature (5984)..(5984): n is a, c, g, or t
  misc_feature (5994)..(5994): n is a, c, g, or t
  misc_feature (5999)..(5999): n is a, c, g, or t
  misc_feature (6003)..(6003): n is a, c, g, or t
  misc_feature (6023)..(6023): n is a, c, g, or t
  misc_feature (6051)..(6051): n is a, c, g, or t
  misc_feature (6074)..(6074): n is a, c, g, or t
  misc_feature (6078)..(6078): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735260 - DNA, 6518 bp, Homo sapiens
  misc_feature (5735)..(5735): n is a, c, g, or t
  misc_feature (5742)..(5742): n is a, c, g, or t
  misc_feature (5762)..(5764): n is a, c, g, or t
  misc_feature (5770)..(5770): n is a, c, g, or t
  misc_feature (5775)..(5775): n is a, c, g, or t
  misc_feature (5784)..(5784): n is a, c, g, or t
  misc_feature (5787)..(5788): n is a, c, g, or t
  misc_feature (5793)..(5793): n is a, c, g, or t
  misc_feature (5811)..(5811): n is a, c, g, or t
  misc_feature (5817)..(5818): n is a, c, g, or t
  misc_feature (5823)..(5824): n is a, c, g, or t
  misc_feature (5829)..(5829): n is a, c, g, or t
  misc_feature (5831)..(5831): n is a, c, g, or t
  misc_feature (5846)..(5846): n is a, c, g, or t
  misc_feature (5850)..(5851): n is a, c, g, or t
  misc_feature (5853)..(5854): n is a, c, g, or t
  misc_feature (5860)..(5860): n is a, c, g, or t
  misc_feature (5863)..(5864): n is a, c, g, or t
  misc_feature (5866)..(5867): n is a, c, g, or t
  misc_feature (5870)..(5871): n is a, c, g, or t
  misc_feature (5876)..(5876): n is a, c, g, or t
  misc_feature (5884)..(5884): n is a, c, g, or t
  misc_feature (5886)..(5886): n is a, c, g, or t
  misc_feature (5889)..(5889): n is a, c, g, or t
  misc_feature (5891)..(5891): n is a, c, g, or t
  misc_feature (5893)..(5894): n is a, c, g, or t
  misc_feature (5901)..(5901): n is a, c, g, or t
  misc_feature (5904)..(5904): n is a, c, g, or t
  misc_feature (5906)..(5906): n is a, c, g, or t
  misc_feature (5921)..(5922): n is a, c, g, or t
  misc_feature (5929)..(5929): n is a, c, g, or t
  misc_feature (5932)..(5932): n is a, c, g, or t
  misc_feature (5939)..(5939): n is a, c, g, or t
  misc_feature (5944)..(5944): n is a, c, g, or t
  misc_feature (5947)..(5947): n is a, c, g, or t
  misc_feature (5951)..(5951): n is a, c, g, or t
  misc_feature (5954)..(5954): n is a, c, g, or t
  misc_feature (5958)..(5958): n is a, c, g, or t
  misc_feature (5961)..(5961): n is a, c, g, or t
  misc_feature (5964)..(5964): n is a, c, g, or t
  misc_feature (5968)..(5968): n is a, c, g, or t
  misc_feature (5978)..(5978): n is a, c, g, or t
  misc_feature (5981)..(5981): n is a, c, g, or t
  misc_feature (5984)..(5984): n is a, c, g, or t
  misc_feature (5994)..(5994): n is a, c, g, or t
  misc_feature (5999)..(5999): n is a, c, g, or t
  misc_feature (6003)..(6003): n is a, c, g, or t
  misc_feature (6023)..(6023): n is a, c, g, or t
  misc_feature (6051)..(6051): n is a, c, g, or t
  misc_feature (6074)..(6074): n is a, c, g, or t
  misc_feature (6078)..(6078): n is a, c, g, or t
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccacncccgtcncccccccgcccccgcccaannnaccccnacccnacccccgcncannccccnaccccccccccccccccncccccnnccccnnacccncncccccacccaacccngagnnanncacccncgnncnnccnnaaccncccccccnanccnancnncaaccanccnanaacacccaccccacnncaacacnacncacaaanacccnccncaanccncccncanacncccnaccacccccnccnaancaccccagancaccnaacnccccccccccccaagccccntccatgcccccaatcccagcccccgcanccagagaccacaggccccccccncganaccctggcccccccccataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaaaaaaaaaaaaaaaaaaaaaaaaaggggggggcggctaaaaaataacctagagggcaagtttaagcgtaccaggtttttggtcaaaagggccctaaggggggaataaaaggagggaggggcgtacaacgtcggtgggaaacggcgttgggctttggaagagcttcttttggtggcgtttggaatctaagaattagctaggaataatacgttatggtacacgttctgggaatgcgtaa

SEQ ID NO: 735261 - DNA, 5661 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatccgtcgacgcggccgcgaattta

SEQ ID NO: 735262 - DNA, 5657 bp, Homo sapiens
ctcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccgtactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaagataagcaagatctaagaagttatcaaaactattctttaaaatgctaaagcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagcaaatgagctgcgaagtgttctgctctagcaccgtgtttaccttacacagaacctactaaaaactgaaatgtcacttttgtacgataatcatggtttttaagaggctgggtaattggccagttaacacatcatctcttgcatttcaaaattttgtgttaaatggagctcttcacaatttcatgagtcctaatttgtgtgaagcacaacacgtcatacattgctaagtgattcttctcatcagaaagctgatttcttagagtatttctaagttaaattaggtatttcattcctttatcaacctgctggctttccaaccctaacatatgcacacattcttataaactctaccttcattttagtaaatccatccattcatttgctcattcttttaataaatatttgtttatcatatattataaactgcactgctattaccaataccaagttacatgtccattccagtcacacagtagtttgatggtattcccatcttacagatg

SEQ ID NO: 735263 - DNA, 71499 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaagaaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735264 - DNA, 70618 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaatggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735265 - DNA, 71526 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaagaaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735266 - DNA, 1884 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaatgggttgaccttccaggctcaagctgagctgaaccaagggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttag

SEQ ID NO: 735267 - DNA, 1630 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctcagtagcaggcttggtcctgcttcttggggcctgagtaactgagtgttagagccgtcctgaggaaggacctgaggcgccagtgaggagacagtggaagctaggaagttggacatctggagacttgtatcttttctggcctgacctctccccttcttggggctcaggtgctctgcctgcagtagggatcacacctggcatcaggtgtctgaaaagagctttgaggtccttggagtggaatgtgctgtgtaagtaccagagactccaggtgttcagggacagtgagccctccccattgtcaatggtagtccaatcagggcagcctatgggctaggcccatgctgttctcaatgctcacacccgccttttcctacaaccacag

SEQ ID NO: 735268 - DNA, 7257 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggttccatttttgaatgaactagtttaatgtggatccaaatttattgtgcatattctttcgttttggttttcaaaagatggcttattcacatggaaatgtacaccagtttagccctgggccctccctttaccttcatatgtgtaaaagcttacacaggtttcagaaaataaatggtttcattttctctaaaataactagtacaaaataaaacagatgtcagttgttgaaaaagcagtacctcttttttcatccctccagatatggcattttggttcttaggggaacaagacagctgtaacatcagcccactggcatctgttttgggcactgaagaggaaaagtgttcagtagagttaagattattgtttctcacgtcagcattgggaccctagggaagggcagtggtgttcctaatgttaacaatctagcactactattcttttcctcacctctccccacccactttctaaaacaacttgaagttttacagaaatccaagttactgtgataaaatttataactccagaaatatttggaactcttgccttacattgaaaatttttgagaaccattgctttaaatgagatttaataaccttggacttcgtctgaagcatcagtgctaacaacttcaggagtcatttggggccttaaacggttctatttagaatccaagtcttttgggtctgaggccttttgtgacatatgtagtcagttcttgctgtgatgtgtggggtgggtggatgctgttcaaaagcagaggtctgacagtgggtgcctctgcttgagagggttggccttccctctgtctgcttactgccttgggagggaatgcaaatggacacgtagctgcagcataaacagtaggagggacaggaacctggcagaccctctgccacaccctgggtcccttctacattattcattttgcttttatccttctgggctgccaagaggtaatgaagccagcagtgtactgtgggaagctgacatcccccacctaaccttccacttctgccctccagaccagatggttaggtcagttctctcaagctcgcttgcatcttgaggcttttcctttcaatgtgtttctgctagaagcctgtttagttctcacctgtctttaaaatagaaagaaaaataaccttccttcaatgctgctatcctgctattacaaactaccatttttcacttttttttttttatacagggtctcactcttttttttcaggctggagtgtgttggcacaagcctgtctcactgcagcttcagccccatgggctcaagagatcctcccacctttgcctcccaagtagctgggaccacattcgtgtaccaccatgcccagctaatcttttgatttttttatagagcccaagtgtcttgctgtgttttctaggctggtccccaacacctgagccctagtgatcctcccacctcagcctcccagggtgctgggattacaggcatgagccactgcacctggcctacttcttacttttcaaccaaattctgaagactagtcttcatcattgcctcacttgcaactcaattcttatgcctgttaccggtgcagagacaatttaccattgggcttcggctgtcactcctccaagaaaaccaccttcactagggtcttccatttgacgtccttgtaggcaaatcaggtgactttcgtagtccttttcctcctccaactttcccctccatgacaacagtgtccctgcaattctattgatctttttaaattagttccatagcttcccctgtgttcccaaagtatgagtgtcctggaggcttggattcaaatcctgactcaacttcctattagtttacataacattgggtaaattacagctctgtgtctcggtttcctcatttataaaatagggaaaacatcagaaggttgtgtgaggatgcctgacacttagtaagtactcagtaagtgttagtgctgccattgttaccacccccatcatcattgtcacttgtgttgctatgtgcagccatggctttggagcaagatctcgcaaggctgcccagtatccctttgtgtggctcccagaggtgagagagaggcctgctgagccctttgcgtttgcttacatggctacatgggaggcctggctacctcttcagtcccttcagccaccatccaccctgtctcagggctccatccaagccatttaaagagccatttctgttcacaaagacagactcaaaattatgattctgctaattataaaaactatcaggaaaaaaattttcaggcttttactgagtacccaaggcagcacttgctctgtggacatgttgacttaccaagttctatctgatcagtcacactcacatgaagataggcagttgactcagctgacttagagcaattttcagaaaacagaaactgaaagtccagggttattccatagtccatgccataaatcccagggtttcttgctggtttcgtgtttgctggtcacatattataaactcataaagacaaggaaggccctgcccccaccttcatcctgtgtttggccacatgatcttgtatggagtggaaagatgggaggggaggattgcaggtgagtctagcatttttagcttcagccttttgctttttctttcctggactacatgcacatgcaaatttggggtatttctgtattttgtgctttaaatttttttcttgttgggccttaattcttgttgggtaccctgggaagagtaaaataaagttaactctgaaccattcttttggacttgctgagggatcagggcaccctaagtgaccaggggcacttctgctttcagcagaggatggaggaagggctgtgcttagcattctgaaggcctcgttctgagtttaaaccaatccagccttctttggactcctgttgttcccaagacactatgttctgaacatctatgaattttatcttcatccaaaaattaccctgaaatggaaactgccatccctcacagatctttttctctcttctggcttgttttgctgtgcttactgctcacttttcacttcttgatcctaattccctggtttcatgtataaatatttgaaggagaaactggtagcaaaaaggctgttactcagtctggtcattcattaaaagttatcactgaacatttgcaagtgctctctggtttcagagattgtgcattttttcccttgtcccggatgcacatgggtagttaagagctaatgttgccttctgggaactattagttgaaaaaatagcttttacataggcaaatttaaatagagggatgtaaattacatcagtgatggaaagggtagactttggagggctagatggggtcttagagaatttctagtcagatgaggaataggcaaggtgagaaatgtgtctgcagctacagaacccattaatgacaagcatgcagagcactcctctgtcctctaattcccaaattcttccttgccactctaccacctcttatcaatactaatcatttttcattccatctccagtatccagagaggaaggtattttaattagtcccttctaattatgtgctccttttttccaccccattttgtcacctaataaaccctaataaggtccctttgtagaaatgggaaacagtgtctgaagtatccattgctaggctaggaactctcattccttctgcataagctgactgactcaactaaagaaacgcatctcactttttccccatcccatcttgactgtgctattccaaacgccaccttggtctaacacagggctcaccatttcagataggagcgtgttgcatgcacacatgcagcaccaaggccaatgcgtagcacacagtaggtaatcaccccagccagaagccatctttcccgtggtgtctctagtctctgctagtcaggttacgcttgtcagcactgccctgtgatatttccatgtatagacatatttatctcctcaactagatagtaagtaagctttggggcaaagaagccatgactaatacattttgtttccccacagtatctgcctagtatcttgtacgtaatttgcacctgataaaaatggttgattatgaacaatttccttgaggaaattaccttaagggtgctaaagaggaaagcctggaaattctagtacttgtgaggacttatgaataagcacgggccttacaaacctttctgaaactcagcccaaactgaggcctataaattgagattgttaggatttaatatgagtagatctggttttgctagccacggtgtacatgttttctttgtctttctcccgctgttgtgttctggttgtttaggacccattgggcttgtaatacagaattgtcaagcactccctaccctgagtaagaagctttccggctgctcaggagtctctggctggaaggccatacttaagctactaggctaccccgccttgagcttcgcttggctttgtactattctaccagtttggctggctgcctggccataagtaactctgactatgtttgtagcctggagagaatctcccagacaagtttgatgtctaggggcacagtaacatgacatccatgttattgacttacgaacttactctagcaaggcagtacccaggcaacccacagccattgtagaggtgtggttgtttcctgaaatggcccaatctcatgctcttcctgtgttgacatcaagcaccgacagctttttatgaaagtctctttagccaggaaggctgaagtagtgacacagcagcattgttcagttcggaatagttaacagtggtttcagagtttggctggaatcttgggtcttgatgaaacacattgtacccattcctgtctcaagccaggccctagcagaattagtgacctaaagctttcatttaagtagtattttaatgtttccagacatagccaagctaaagactttaaagcaacctaaagaaccagaggagatgggaggagtacagttcaggagtcggatggctctgagtttaaagccaggccatgctactgtgcagctggtgattttgaataaagcggtgtacttctctgatccttgggttcttagtagagctacctctgagactaatcttgtgagttaagctctgtaaagcacttggcaccttgtatgtcacaaagaaggccttcacggatgcagtggctcacgcctgtaatcccagcagtttgggaggccgaggtaggtggatcacctgaggtgaggagtttgagaccagtctggccaacatggtgaaaccccatctttattaaaaatgtaaaaattagccaggcaacgtggcatgtacttgtaatcccagctactctggaggctgaggcagaagaatcacttgaacctgggaggtggaggttgcagtgagctgagatcacaccactctactccagcctgggcaacagagcgagactacgtctccaaaaaaaaaaaaacaacaacaacaacaacaacaacaggctgggcgcagtggctcacacctgtgacctataatcccagcattttgggaggccaaggtgggcagatcacctgaggccaggagtttgagaccagcctggctaacatggtgaaaccgcatttctactaaaaatacaaaaaaattagatgggcgtggtggcgcacacctataatcctagctactcaggaggctgaggcaggagaatcacttgaacccaggaggcggaggttgctgtcagccaagatcacgctgttgcactccagcttgggcaacaagagcgaaactctgtctcaaaaaaataaaaaaataaataaataaataaagcctacagtagccattattgtatttcttcagccttttcccaccttaccctctcgtttccagccacccaagcagttgctgcaggccaggttccctcactgcctggattgggtttttattttgtcccctgtgctttttctcatattgccacag

SEQ ID NO: 735269 - DNA, 1634 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaagggaacaaagatgaagttaaccctcccacctgtctttccttatgaacacttgccttttccaactgttttctgccatggctaatcagaaaaagtttcttaaggaaatggtggcaaaaaaaaaaaaaaaaagacacaaaggtaacaaacaaagctggacctatttataatgttccagtaagcagaagtacctagagactgacttgctaggatttagtctgttagaagatctcaagaagtcaagagacatgatgaaggaggaaaggctgaacttcagacctgcaacttcccagccagagtgaatcagccagtgacctaaccacactttgttcagagatgtcaaggaaaagtgttctctcggccaggtgccatggctcacagctgtaatctcagcactttgggaggactgcttgaggccaggagctcaagacaagcctgagcaacacagtgagacccccatctctacaaaaaataaaaacaaaaataaaataagctaggcatagtgatgtgttcccatagtcccagctactgcggaggctgcactgaaaggattcgcaggaattcaaggctgctgtgggctatgatcagggcactgcactccagcctgggcaacaga

SEQ ID NO: 735270 - DNA, 10430 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggtgagtttcctgagaaagctgagtagctggccactactagcttggaacttgttgcagagcttagcagagcactcacctattgggaaggaaatgtagtcagagatattcaggtagcatggttgccttatttttgactgtttggaggatcactgcacaccttacgtactccagtttatccttaacaaaatatgtcagatataatggagctatttgtgagataatggtaggagttatcttttaaaatttgtattatttgtaataaattcaagaaattataactatacactatagtataaagagtggccaagagttcgtttgggataacagtaaagattccagaggtcattaataccctagacctccatgagaattcctttcctatggttcaaagttaatactttattgtaaatgagcacttgcagaaatgtgtgtaatgtatgtgaaaaacaacctgggcaccattgattttccagccccaataattgttatttccaaggcgtataaagagcattttaagctgtgggacaaaagacttgagtgaagagacatgttcatgtgaaacagaaaaaaaataaccattcttccccactcccttctggaacctagtgttttccctggagggctaggcaccagctgtttctacatttgaaaaacaaaattagaagctttgagtaaaagcctatgggttagggtcactccctggaatttggagaaaacatctgcatggctagttccatccttgacagagagtgtagttgtctgtagcaattcattggaataactggcaagctgggaagaggacctgtgtttttgctttagtgatccagtgttttataaagaaggaactattctgttaagaacaatctttgcttttgggtgcactttgatttagttctgtggtgggggtcctggatttgtttggttatccaagatcaaatttggaacccttatgctttcattttttatattgtcactctggtaagttatggcctctatactttatctaaggtgtggctttccatgtggcgtaaacatggagaagttctgacctttataaagaacaaaacaggccatgtacatacctggtattgcaaaaccagaatttgccatgggttaagcctacttagtgtggacttgatttaatgaccttaaaccaaggtacttacctggaataacaaccttcctgggtacaacactaagtaccacggaaatctttatgactagagacagactcacccctttagtcaaagtaaacacatgccaaagattatctcttaggcttctttgacctgttgacagttggtgcttattcctgtaccatagtatcaattaaaattgctttggtaaactatatggaaaagagctgccttctcctaagtctcacctaaccaggagtggcactggggcagtgtttctcaaggggtgagttgcggaccacccacatacgattcactactgaatcagcctttctggatggaaacctgggaatctgtatttataacaagcagtcagatgattcttaggcattcttaagtttgaatacattgggagaggtgggtcataggatcacaactataccttttccttatccagcctattttacaatgccataacattcttccttaagtccttataattacattattctaaatcctattttctcctttctttcttcaaggaagttaaaggtttgaatttggtagtcttacaaatggaatagtctgtcatttgttgtggctcatttatttactcattcatgccattcaacacatacttactgagggtctgctacatgccaggcactatcctagatactgggagtacagcagtaaacaaaacagacaataacaggagctcttgctctgatgaggaaatgattaaaaaatgaagtaagaatttaaaatatatgtattatgtcaggtaagtaccatggagaaaaacagagaagaagagttgcaattttaattatggcagagaagaagagtgttgctggcaaggtgacattttagcaaagctttgaacaaagtgaagcaaagagtagtgcatctgtctggtaatgagcattccaggcagagggaatgcaagtgtggtagcactgagacaggaacctgtaagcattcctgggccaggcagggaaaacagaggccagagtgggtagagtggaatgagtgaagggatggtggcaggagatgctggcagaaaagtagcaggactaggagagaggagtggtccaggggaaccagattctagagccagtcaacaaaaccccaatttgagaatttactagataccattctaatttcagaatcctcctatcctgtgttataatccaaatatgtcctactgacagtgaatgaaggaaatgtctataagctctcaacctcttcctctttaaaaagcgagctgccagcgctgtttcataggtgccgtgagtcgaacagaatattttggtcccttagacttatcagttctcactaaacctggcgtttttttaagtgtggtatttgaactaaaggaaataggctcattcttagattgtggtaattaaggttatgacattatgtaaataatcatgaaatgattattttaccatgtgagttttgggaaacttagattcttaaagggaaagcctttgatttgggtctctctgtgttccagtctcctttgacttaagcatctttatgtttcagctgacttctcccttagcatttggattatctgtcatatgcgtcctaagccttttgttttttaaagagaaagcaatatgttaattgaattggatcctaaccaataataggggatacttgtgtaaaaaagaaagaaagctttaaatgtgggacccaaactctatttaccctttgttttctgtatttctactataaattaaacattttaaaaaatggttggctgggcatggtggctgatgcctgtaataccagcactttgggagacaggcaggtggatcgcttgaacccaggcgtttgagaccaacctaagcaacaaggcaaaactgcatctctacaaaaaatacaaaaattagttgggcgtggtgatgcttacctgtagtcctggctacttgggaggctgtggtgggaggatcacttgagtctgggaggtccaggctgcagtgagctgtgatggcaccgctccagcctggatgacagagtgagaccctgtctcaaaaaaataaaaaataagaattacctttttcttgaggaaaaaaatcagtaataattgacattgtattgcaatgtaaaattaaatccacacagcagttgtataaggtatggtactgttatttgacagttagttattactgctgttgctcctgtcagtgttgttaacaggctcaagatcactatcccatctgtaacaggacaggggctagaactcaggattgccagttgcaagttccatctttttcctataccatatgtgtaagcagtttaaggatattttaaagaaatcttgcttaaatacttgtatcttgtcattgtcctgggagcttcccctggataggcctattaatcttggcagtgtgtcataccacggctactacagaaatgctatcctctgaggtggcgtatgtaggtaacactgaaatgcagggtattaaggatcatttaaagcctataatttctttctgagttcacatagttgctctgagctcaagaaaatagaccattacagttggtggttcatttgggttttgccataggtcccagagttagcaagtagaccctcgaactctgttgtttgagtcttttgtgttccttgcagtttctcaactgtatgtggagttccactgttgttccactgggaacaataggatggaattagaatcatcagccagccaaccagagtaatggagtaagggcaagatcaactgtggccccctccccgctttttttttttttttttttttttttttttttttttttttttttttttacagagatgctacttttatagaaagtattatttaagtgtccttgcttgggtactagggagtgttacacaatggttcactggcactaagctcaccatacttatgttggggagcaagacctgatagccagcctttacatgggagtataattctgtcctccatctcataagccccagtacctgagccagaatgattataaccaaccacactgtctctttatcatggatggctttagcagtaggttattttcatcattgccatttgtagctctacagtggtttatagtaatttctcatcttttaagtctctccctcagtgcctgttgttatcaaactcattgctctctcaggcagttgagctctgcatttctcccttatggggagagctgtgttggagagagagaatataacttcaaatgaaaataaagaaaaacagaatttcttgattttgaggtgagaatttgagggcactgcctctgtcagttcctatcacagattctggcacatagtaggttctcagttagtaaattgtggtggagagagagagccagaggaaacagcaggcttgctcagccattaaagaaaacagcaacagtcaatattatgtgctcaactatataagtaagaccttgtgagtgctgtagaggttaaaagacataatagatggtgtctacccttgagggtcttgctctgttgttgggaaagaggattacatctaacaattaacaataatgagataacatgctgagcatcagataagagctttacattgagttaatctcagtttcatttccattaaaatctggttttcttaacaggtagatgttgaaaccaaatataatagttcccttatggcagggaacatgattcttaaggataaaggctctcatagcatttatacttttatgtacacacatttatatattatacttaatatatgaggttttatatatatttgtgtgattattaaatgactgtctgctggcactacactacaataagtaccgtgaaggcagggagaatgtctccttttggttatatttcttccctcagtgcctgcacatagtagggagcatagtgaatatttattaactgaggggaggaatcccccatcaacctggccacattattttgggagatggctcattcctgttgatgcgtttaaggctgacagttcattcggtaacctatgtctatagcatatctgagctgctagagggattgtcgtttaaatgaaatgtaaactatagccctatccacttctcctcattactcattaaggttatattagctagtcagactccaacttgggcaattatctttttaaagtttctacatcttaaattgttgcccatagttgcccaagtctcccttaggctccaggctcagcaattgtaaatgcatttaatttcttataaattatttgcatgctgctgaaaacctccaagggcttttcattgcccatttaggtaaggactggtattccatgttctgtaaataagatacccagcttacctacctgctttttcgcctccttcctgacattaaccttccagttactatacacccttgtattagtccgttttcgtgctgctgataaagacatacctgagactgggcaatttacaaaagaaggaggtttagtggacttacagttccacgtggctggaaggaagcctcacaatcatggcgaaggcaaggaggagcaagtcatgtcttacatggatggcagcaggcaaagagagagagcttgtgcagggaaactcctgtttttaaaaccatcagatcttgcaagacttattcactatcacgagaacagcatgggaaagacctgtccccgtgattcaattacctcccaccgagttcctgccacaacacatgggaattacaattcaagatgagatttgggtggagacacagccaaactatattattctgctcctggcccctcccaaatctcatgtcctcacatttcaaaaccaatcgtgccttgtcttaactcatttcagcattaactcagaagtccacagtgcaaagtctcatctgggacaagacaagtcctttctgcctatgagcctgtaaaatcaaaagcaagttagttacttcctagatagagtgggggtacaggcattggataaacacagccattccaaatgggagaaatcggtcaaaaaaaggggctacaggcctcatgcaagtccaaaatccagcagggcagtcaaatctaaaagccctgtaatgatctcctttgactccatgtctcacatagaggtcatgctgatacaaaaggtgggttcctttggtcttgcatagctctacccttgtggctttgcaaggtacagcctccttcctggctgctttcacaggctggcattgagtgtctgcagcttttccaggtgcacagtgcaagatgtcagtcagtggatctaccattctggggtctgcaggatggtggcactcttctcacagctccactagagagggccccagtagagactgtgtgggggctctgaccccacatttcctgtctgcactgccgtagcagaggtcctccatgagggccctgtcccttcagcaaacttctccctggacatacaggtgtttccatactccatcctctgaaatctaggcagaggttcccaaaccccaattcttgacttctgttcactcccaggctcaataccatgaggaagctgccaaggcttggggctggcaccctctgaagccgcaacctgagctctgcattgggccctttcagccacgactggagtggccgggatgcagggcaccaagtccctaggctgcatacaacctgtggaccctgggcccagcccacaagaccagtttttcctcctaggcctctgggtctgtgatgggaacagctgctgtgaagatctctgacatgccctggagacattttccccattgtcttggggattaacattcggcttctcattacttatgcaaatctctgcagctggcttgaatttcttctcagaaaatgggattttcttttctatcacattgtcaggctacaaattttctgaacttttatgctctgcttctcttataaaactgaatgccttttacagcacccaagtcacctcttgaatgctttgctgcttagaaatttcttcctccagataccctaaatcatctctgtgaagttcaaagttccacttatctctagcgtaggggcaaaatgctgccaatctctttgctgaaacgtaacaggagtcacctttgctctagttctcaacaagttcctcatctccatctgagaccacctcagcctggactttattgtccatatcattatcagcattttgggcaaagccattcaacaagtccttaggaagtttgaaactttcccacatttttctgtcttcttctgagcccttcaaattgttccaacctctgcctgttacctagttccaaagttgcttccacattttcaggtatcttttcagcagtgccctactctactggtaccaatttactgcatttagtccattttcatgctgctgataaagacatacctgagactgggcaatttacaaaagaaagaggtttaatgacttacagttacatatggctggggaggcctcacaatcatggtggaaggcaaggagaagcaagtcacgttttacatggatggcagcaggcgaagagaacttgtgcagggaaactgctgtttttaaaaccatcagctctcacgaaatttattccctatcacaagaacaacatgggaaagaccaacccccatgattcaattactgctcactaggttcctcccccgacacatgggaattgtgggagttaaattcaagatgagatttgggtagggacacagccaaaccatatcaacccctcttctgtttgcccaggaatttcattctcagcttatctgagtgctttgcttttctcaaggtccaaccccagccacactgcccaggtgacttgggggttccatattgatgagccctgctcacaaggcctacctgcagcctgtcctctatttcctgagttccccccttccctcagtctccagctccttgccttagaggccaatatcaaatactgcccctcccttagaactctcccttgaacctctgtggccttttgtgggacctctcctcagtctccctaatttctgtgattaacttatcacctaattaaatggtatgctcctgtagggcagaaatctaattattccttctgggagactgtcatacagaatgagagaggtctcactcccccaagagtactagagagctcttcacctaacatttttcgcatcttgagattcggaaggatagagattgattactaggccttgcctttagcatttttgttttctccaacaaaattgcaaaaactttagaaaaatgggaagaagaaaaaacatgaatccctccttcctctaacacaactacagccttccctttggctatgacaaatgctgcccaacagaaatttagcatgagtcacaattgcattttaaatataacttaaatacaattaaattttcgagtagaaccaattaaaaagttaaacaggtgaaaatttgaataatataatttatttagcctaatattcaaaagtaagtatgatctcaacatgtaatcaatatatttaaaattatttattcaccaagtctttaaattcaacttaacagcacatctcaattcagagtactcacatttcaagtgtttattagccacatgtggctagtgactatcagatcagatagtataatccaaaaatagactctccgtaccccccctgccccatttaatgtgactaaaattagacatcatcttaaagtggatgtgaaaagaaacctgcctcctttttttctccccaaaagctgctattgttcaatccatggatttattgatggagtctaacaagcaaggaaatatagtgttatcaatttgtgtattccttcctggtctcttcatctacatgctccccacagggaaagtactatttatagcttgctgcttttacataatatattttttcgctaggtcatacagtgtgctcatgtttagtcattaggcatgtttcttttgggcaattggggttgcattcaatttttaaaatttaaaatttataattataatatggacatctctgtatatgtagccatttccatagactccaagaagttggatttctgggttgaggggtgcgagcatctgacctttttccgtgtgttgccaaaatgctttccaagaggattgtttttatatcctctttcttccatttctttctttttttcaagcaaattctaaagagtagtcttttggtagtgttttgagagtaccagtttcattatcactggaatttttttttttggaagagggtaactaattcagtaaacaaaagttagtaattttgtattctatttattacttgtgaaattaattgcttttccacatgtttatttactag

SEQ ID NO: 735271 - DNA, 7284 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggttccatttttgaatgaactagtttaatgtggatccaaatttattgtgcatattctttcgttttggttttcaaaagatggcttattcacatggaaatgtacaccagtttagccctgggccctccctttaccttcatatgtgtaaaagcttacacaggtttcagaaaataaatggtttcattttctctaaaataactagtacaaaataaaacagatgtcagttgttgaaaaagcagtacctcttttttcatccctccagatatggcattttggttcttaggggaacaagacagctgtaacatcagcccactggcatctgttttgggcactgaagaggaaaagtgttcagtagagttaagattattgtttctcacgtcagcattgggaccctagggaagggcagtggtgttcctaatgttaacaatctagcactactattcttttcctcacctctccccacccactttctaaaacaacttgaagttttacagaaatccaagttactgtgataaaatttataactccagaaatatttggaactcttgccttacattgaaaatttttgagaaccattgctttaaatgagatttaataaccttggacttcgtctgaagcatcagtgctaacaacttcaggagtcatttggggccttaaacggttctatttagaatccaagtcttttgggtctgaggccttttgtgacatatgtagtcagttcttgctgtgatgtgtggggtgggtggatgctgttcaaaagcagaggtctgacagtgggtgcctctgcttgagagggttggccttccctctgtctgcttactgccttgggagggaatgcaaatggacacgtagctgcagcataaacagtaggagggacaggaacctggcagaccctctgccacaccctgggtcccttctacattattcattttgcttttatccttctgggctgccaagaggtaatgaagccagcagtgtactgtgggaagctgacatcccccacctaaccttccacttctgccctccagaccagatggttaggtcagttctctcaagctcgcttgcatcttgaggcttttcctttcaatgtgtttctgctagaagcctgtttagttctcacctgtctttaaaatagaaagaaaaataaccttccttcaatgctgctatcctgctattacaaactaccatttttcacttttttttttttatacagggtctcactcttttttttcaggctggagtgtgttggcacaagcctgtctcactgcagcttcagccccatgggctcaagagatcctcccacctttgcctcccaagtagctgggaccacattcgtgtaccaccatgcccagctaatcttttgatttttttatagagcccaagtgtcttgctgtgttttctaggctggtccccaacacctgagccctagtgatcctcccacctcagcctcccagggtgctgggattacaggcatgagccactgcacctggcctacttcttacttttcaaccaaattctgaagactagtcttcatcattgcctcacttgcaactcaattcttatgcctgttaccggtgcagagacaatttaccattgggcttcggctgtcactcctccaagaaaaccaccttcactagggtcttccatttgacgtccttgtaggcaaatcaggtgactttcgtagtccttttcctcctccaactttcccctccatgacaacagtgtccctgcaattctattgatctttttaaattagttccatagcttcccctgtgttcccaaagtatgagtgtcctggaggcttggattcaaatcctgactcaacttcctattagtttacataacattgggtaaattacagctctgtgtctcggtttcctcatttataaaatagggaaaacatcagaaggttgtgtgaggatgcctgacacttagtaagtactcagtaagtgttagtgctgccattgttaccacccccatcatcattgtcacttgtgttgctatgtgcagccatggctttggagcaagatctcgcaaggctgcccagtatccctttgtgtggctcccagaggtgagagagaggcctgctgagccctttgcgtttgcttacatggctacatgggaggcctggctacctcttcagtcccttcagccaccatccaccctgtctcagggctccatccaagccatttaaagagccatttctgttcacaaagacagactcaaaattatgattctgctaattataaaaactatcaggaaaaaaattttcaggcttttactgagtacccaaggcagcacttgctctgtggacatgttgacttaccaagttctatctgatcagtcacactcacatgaagataggcagttgactcagctgacttagagcaattttcagaaaacagaaactgaaagtccagggttattccatagtccatgccataaatcccagggtttcttgctggtttcgtgtttgctggtcacatattataaactcataaagacaaggaaggccctgcccccaccttcatcctgtgtttggccacatgatcttgtatggagtggaaagatgggaggggaggattgcaggtgagtctagcatttttagcttcagccttttgctttttctttcctggactacatgcacatgcaaatttggggtatttctgtattttgtgctttaaatttttttcttgttgggccttaattcttgttgggtaccctgggaagagtaaaataaagttaactctgaaccattcttttggacttgctgagggatcagggcaccctaagtgaccaggggcacttctgctttcagcagaggatggaggaagggctgtgcttagcattctgaaggcctcgttctgagtttaaaccaatccagccttctttggactcctgttgttcccaagacactatgttctgaacatctatgaattttatcttcatccaaaaattaccctgaaatggaaactgccatccctcacagatctttttctctcttctggcttgttttgctgtgcttactgctcacttttcacttcttgatcctaattccctggtttcatgtataaatatttgaaggagaaactggtagcaaaaaggctgttactcagtctggtcattcattaaaagttatcactgaacatttgcaagtgctctctggtttcagagattgtgcattttttcccttgtcccggatgcacatgggtagttaagagctaatgttgccttctgggaactattagttgaaaaaatagcttttacataggcaaatttaaatagagggatgtaaattacatcagtgatggaaagggtagactttggagggctagatggggtcttagagaatttctagtcagatgaggaataggcaaggtgagaaatgtgtctgcagctacagaacccattaatgacaagcatgcagagcactcctctgtcctctaattcccaaattcttccttgccactctaccacctcttatcaatactaatcatttttcattccatctccagtatccagagaggaaggtattttaattagtcccttctaattatgtgctccttttttccaccccattttgtcacctaataaaccctaataaggtccctttgtagaaatgggaaacagtgtctgaagtatccattgctaggctaggaactctcattccttctgcataagctgactgactcaactaaagaaacgcatctcactttttccccatcccatcttgactgtgctattccaaacgccaccttggtctaacacagggctcaccatttcagataggagcgtgttgcatgcacacatgcagcaccaaggccaatgcgtagcacacagtaggtaatcaccccagccagaagccatctttcccgtggtgtctctagtctctgctagtcaggttacgcttgtcagcactgccctgtgatatttccatgtatagacatatttatctcctcaactagatagtaagtaagctttggggcaaagaagccatgactaatacattttgtttccccacagtatctgcctagtatcttgtacgtaatttgcacctgataaaaatggttgattatgaacaatttccttgaggaaattaccttaagggtgctaaagaggaaagcctggaaattctagtacttgtgaggacttatgaataagcacgggccttacaaacctttctgaaactcagcccaaactgaggcctataaattgagattgttaggatttaatatgagtagatctggttttgctagccacggtgtacatgttttctttgtctttctcccgctgttgtgttctggttgtttaggacccattgggcttgtaatacagaattgtcaagcactccctaccctgagtaagaagctttccggctgctcaggagtctctggctggaaggccatacttaagctactaggctaccccgccttgagcttcgcttggctttgtactattctaccagtttggctggctgcctggccataagtaactctgactatgtttgtagcctggagagaatctcccagacaagtttgatgtctaggggcacagtaacatgacatccatgttattgacttacgaacttactctagcaaggcagtacccaggcaacccacagccattgtagaggtgtggttgtttcctgaaatggcccaatctcatgctcttcctgtgttgacatcaagcaccgacagctttttatgaaagtctctttagccaggaaggctgaagtagtgacacagcagcattgttcagttcggaatagttaacagtggtttcagagtttggctggaatcttgggtcttgatgaaacacattgtacccattcctgtctcaagccaggccctagcagaattagtgacctaaagctttcatttaagtagtattttaatgtttccagacatagccaagctaaagactttaaagcaacctaaagaaccagaggagatgggaggagtacagttcaggagtcggatggctctgagtttaaagccaggccatgctactgtgcagctggtgattttgaataaagcggtgtacttctctgatccttgggttcttagtagagctacctctgagactaatcttgtgagttaagctctgtaaagcacttggcaccttgtatgtcacaaagaaggccttcacggatgcagtggctcacgcctgtaatcccagcagtttgggaggccgaggtaggtggatcacctgaggtgaggagtttgagaccagtctggccaacatggtgaaaccccatctttattaaaaatgtaaaaattagccaggcaacgtggcatgtacttgtaatcccagctactctggaggctgaggcagaagaatcacttgaacctgggaggtggaggttgcagtgagctgagatcacaccactctactccagcctgggcaacagagcgagactacgtctccaaaaaaaaaaaaacaacaacaacaacaacaacaacaggctgggcgcagtggctcacacctgtgacctataatcccagcattttgggaggccaaggtgggcagatcacctgaggccaggagtttgagaccagcctggctaacatggtgaaaccgcatttctactaaaaatacaaaaaaattagatgggcgtggtggcgcacacctataatcctagctactcaggaggctgaggcaggagaatcacttgaacccaggaggcggaggttgctgtcagccaagatcacgctgttgcactccagcttgggcaacaagagcgaaactctgtctcaaaaaaataaaaaaataaataaataaataaagcctacagtagccattattgtatttcttcagccttttcccaccttaccctctcgtttccagccacccaagcagttgctgcaggccaggttccctcactgcctggattgggtttttattttgtcccctgtgctttttctcatattgccacag

SEQ ID NO: 735272 - DNA, 10403 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggtgagtttcctgagaaagctgagtagctggccactactagcttggaacttgttgcagagcttagcagagcactcacctattgggaaggaaatgtagtcagagatattcaggtagcatggttgccttatttttgactgtttggaggatcactgcacaccttacgtactccagtttatccttaacaaaatatgtcagatataatggagctatttgtgagataatggtaggagttatcttttaaaatttgtattatttgtaataaattcaagaaattataactatacactatagtataaagagtggccaagagttcgtttgggataacagtaaagattccagaggtcattaataccctagacctccatgagaattcctttcctatggttcaaagttaatactttattgtaaatgagcacttgcagaaatgtgtgtaatgtatgtgaaaaacaacctgggcaccattgattttccagccccaataattgttatttccaaggcgtataaagagcattttaagctgtgggacaaaagacttgagtgaagagacatgttcatgtgaaacagaaaaaaaataaccattcttccccactcccttctggaacctagtgttttccctggagggctaggcaccagctgtttctacatttgaaaaacaaaattagaagctttgagtaaaagcctatgggttagggtcactccctggaatttggagaaaacatctgcatggctagttccatccttgacagagagtgtagttgtctgtagcaattcattggaataactggcaagctgggaagaggacctgtgtttttgctttagtgatccagtgttttataaagaaggaactattctgttaagaacaatctttgcttttgggtgcactttgatttagttctgtggtgggggtcctggatttgtttggttatccaagatcaaatttggaacccttatgctttcattttttatattgtcactctggtaagttatggcctctatactttatctaaggtgtggctttccatgtggcgtaaacatggagaagttctgacctttataaagaacaaaacaggccatgtacatacctggtattgcaaaaccagaatttgccatgggttaagcctacttagtgtggacttgatttaatgaccttaaaccaaggtacttacctggaataacaaccttcctgggtacaacactaagtaccacggaaatctttatgactagagacagactcacccctttagtcaaagtaaacacatgccaaagattatctcttaggcttctttgacctgttgacagttggtgcttattcctgtaccatagtatcaattaaaattgctttggtaaactatatggaaaagagctgccttctcctaagtctcacctaaccaggagtggcactggggcagtgtttctcaaggggtgagttgcggaccacccacatacgattcactactgaatcagcctttctggatggaaacctgggaatctgtatttataacaagcagtcagatgattcttaggcattcttaagtttgaatacattgggagaggtgggtcataggatcacaactataccttttccttatccagcctattttacaatgccataacattcttccttaagtccttataattacattattctaaatcctattttctcctttctttcttcaaggaagttaaaggtttgaatttggtagtcttacaaatggaatagtctgtcatttgttgtggctcatttatttactcattcatgccattcaacacatacttactgagggtctgctacatgccaggcactatcctagatactgggagtacagcagtaaacaaaacagacaataacaggagctcttgctctgatgaggaaatgattaaaaaatgaagtaagaatttaaaatatatgtattatgtcaggtaagtaccatggagaaaaacagagaagaagagttgcaattttaattatggcagagaagaagagtgttgctggcaaggtgacattttagcaaagctttgaacaaagtgaagcaaagagtagtgcatctgtctggtaatgagcattccaggcagagggaatgcaagtgtggtagcactgagacaggaacctgtaagcattcctgggccaggcagggaaaacagaggccagagtgggtagagtggaatgagtgaagggatggtggcaggagatgctggcagaaaagtagcaggactaggagagaggagtggtccaggggaaccagattctagagccagtcaacaaaaccccaatttgagaatttactagataccattctaatttcagaatcctcctatcctgtgttataatccaaatatgtcctactgacagtgaatgaaggaaatgtctataagctctcaacctcttcctctttaaaaagcgagctgccagcgctgtttcataggtgccgtgagtcgaacagaatattttggtcccttagacttatcagttctcactaaacctggcgtttttttaagtgtggtatttgaactaaaggaaataggctcattcttagattgtggtaattaaggttatgacattatgtaaataatcatgaaatgattattttaccatgtgagttttgggaaacttagattcttaaagggaaagcctttgatttgggtctctctgtgttccagtctcctttgacttaagcatctttatgtttcagctgacttctcccttagcatttggattatctgtcatatgcgtcctaagccttttgttttttaaagagaaagcaatatgttaattgaattggatcctaaccaataataggggatacttgtgtaaaaaagaaagaaagctttaaatgtgggacccaaactctatttaccctttgttttctgtatttctactataaattaaacattttaaaaaatggttggctgggcatggtggctgatgcctgtaataccagcactttgggagacaggcaggtggatcgcttgaacccaggcgtttgagaccaacctaagcaacaaggcaaaactgcatctctacaaaaaatacaaaaattagttgggcgtggtgatgcttacctgtagtcctggctacttgggaggctgtggtgggaggatcacttgagtctgggaggtccaggctgcagtgagctgtgatggcaccgctccagcctggatgacagagtgagaccctgtctcaaaaaaataaaaaataagaattacctttttcttgaggaaaaaaatcagtaataattgacattgtattgcaatgtaaaattaaatccacacagcagttgtataaggtatggtactgttatttgacagttagttattactgctgttgctcctgtcagtgttgttaacaggctcaagatcactatcccatctgtaacaggacaggggctagaactcaggattgccagttgcaagttccatctttttcctataccatatgtgtaagcagtttaaggatattttaaagaaatcttgcttaaatacttgtatcttgtcattgtcctgggagcttcccctggataggcctattaatcttggcagtgtgtcataccacggctactacagaaatgctatcctctgaggtggcgtatgtaggtaacactgaaatgcagggtattaaggatcatttaaagcctataatttctttctgagttcacatagttgctctgagctcaagaaaatagaccattacagttggtggttcatttgggttttgccataggtcccagagttagcaagtagaccctcgaactctgttgtttgagtcttttgtgttccttgcagtttctcaactgtatgtggagttccactgttgttccactgggaacaataggatggaattagaatcatcagccagccaaccagagtaatggagtaagggcaagatcaactgtggccccctccccgctttttttttttttttttttttttttttttttttttttttttttttttacagagatgctacttttatagaaagtattatttaagtgtccttgcttgggtactagggagtgttacacaatggttcactggcactaagctcaccatacttatgttggggagcaagacctgatagccagcctttacatgggagtataattctgtcctccatctcataagccccagtacctgagccagaatgattataaccaaccacactgtctctttatcatggatggctttagcagtaggttattttcatcattgccatttgtagctctacagtggtttatagtaatttctcatcttttaagtctctccctcagtgcctgttgttatcaaactcattgctctctcaggcagttgagctctgcatttctcccttatggggagagctgtgttggagagagagaatataacttcaaatgaaaataaagaaaaacagaatttcttgattttgaggtgagaatttgagggcactgcctctgtcagttcctatcacagattctggcacatagtaggttctcagttagtaaattgtggtggagagagagagccagaggaaacagcaggcttgctcagccattaaagaaaacagcaacagtcaatattatgtgctcaactatataagtaagaccttgtgagtgctgtagaggttaaaagacataatagatggtgtctacccttgagggtcttgctctgttgttgggaaagaggattacatctaacaattaacaataatgagataacatgctgagcatcagataagagctttacattgagttaatctcagtttcatttccattaaaatctggttttcttaacaggtagatgttgaaaccaaatataatagttcccttatggcagggaacatgattcttaaggataaaggctctcatagcatttatacttttatgtacacacatttatatattatacttaatatatgaggttttatatatatttgtgtgattattaaatgactgtctgctggcactacactacaataagtaccgtgaaggcagggagaatgtctccttttggttatatttcttccctcagtgcctgcacatagtagggagcatagtgaatatttattaactgaggggaggaatcccccatcaacctggccacattattttgggagatggctcattcctgttgatgcgtttaaggctgacagttcattcggtaacctatgtctatagcatatctgagctgctagagggattgtcgtttaaatgaaatgtaaactatagccctatccacttctcctcattactcattaaggttatattagctagtcagactccaacttgggcaattatctttttaaagtttctacatcttaaattgttgcccatagttgcccaagtctcccttaggctccaggctcagcaattgtaaatgcatttaatttcttataaattatttgcatgctgctgaaaacctccaagggcttttcattgcccatttaggtaaggactggtattccatgttctgtaaataagatacccagcttacctacctgctttttcgcctccttcctgacattaaccttccagttactatacacccttgtattagtccgttttcgtgctgctgataaagacatacctgagactgggcaatttacaaaagaaggaggtttagtggacttacagttccacgtggctggaaggaagcctcacaatcatggcgaaggcaaggaggagcaagtcatgtcttacatggatggcagcaggcaaagagagagagcttgtgcagggaaactcctgtttttaaaaccatcagatcttgcaagacttattcactatcacgagaacagcatgggaaagacctgtccccgtgattcaattacctcccaccgagttcctgccacaacacatgggaattacaattcaagatgagatttgggtggagacacagccaaactatattattctgctcctggcccctcccaaatctcatgtcctcacatttcaaaaccaatcgtgccttgtcttaactcatttcagcattaactcagaagtccacagtgcaaagtctcatctgggacaagacaagtcctttctgcctatgagcctgtaaaatcaaaagcaagttagttacttcctagatagagtgggggtacaggcattggataaacacagccattccaaatgggagaaatcggtcaaaaaaaggggctacaggcctcatgcaagtccaaaatccagcagggcagtcaaatctaaaagccctgtaatgatctcctttgactccatgtctcacatagaggtcatgctgatacaaaaggtgggttcctttggtcttgcatagctctacccttgtggctttgcaaggtacagcctccttcctggctgctttcacaggctggcattgagtgtctgcagcttttccaggtgcacagtgcaagatgtcagtcagtggatctaccattctggggtctgcaggatggtggcactcttctcacagctccactagagagggccccagtagagactgtgtgggggctctgaccccacatttcctgtctgcactgccgtagcagaggtcctccatgagggccctgtcccttcagcaaacttctccctggacatacaggtgtttccatactccatcctctgaaatctaggcagaggttcccaaaccccaattcttgacttctgttcactcccaggctcaataccatgaggaagctgccaaggcttggggctggcaccctctgaagccgcaacctgagctctgcattgggccctttcagccacgactggagtggccgggatgcagggcaccaagtccctaggctgcatacaacctgtggaccctgggcccagcccacaagaccagtttttcctcctaggcctctgggtctgtgatgggaacagctgctgtgaagatctctgacatgccctggagacattttccccattgtcttggggattaacattcggcttctcattacttatgcaaatctctgcagctggcttgaatttcttctcagaaaatgggattttcttttctatcacattgtcaggctacaaattttctgaacttttatgctctgcttctcttataaaactgaatgccttttacagcacccaagtcacctcttgaatgctttgctgcttagaaatttcttcctccagataccctaaatcatctctgtgaagttcaaagttccacttatctctagcgtaggggcaaaatgctgccaatctctttgctgaaacgtaacaggagtcacctttgctctagttctcaacaagttcctcatctccatctgagaccacctcagcctggactttattgtccatatcattatcagcattttgggcaaagccattcaacaagtccttaggaagtttgaaactttcccacatttttctgtcttcttctgagcccttcaaattgttccaacctctgcctgttacctagttccaaagttgcttccacattttcaggtatcttttcagcagtgccctactctactggtaccaatttactgcatttagtccattttcatgctgctgataaagacatacctgagactgggcaatttacaaaagaaagaggtttaatgacttacagttacatatggctggggaggcctcacaatcatggtggaaggcaaggagaagcaagtcacgttttacatggatggcagcaggcgaagagaacttgtgcagggaaactgctgtttttaaaaccatcagctctcacgaaatttattccctatcacaagaacaacatgggaaagaccaacccccatgattcaattactgctcactaggttcctcccccgacacatgggaattgtgggagttaaattcaagatgagatttgggtagggacacagccaaaccatatcaacccctcttctgtttgcccaggaatttcattctcagcttatctgagtgctttgcttttctcaaggtccaaccccagccacactgcccaggtgacttgggggttccatattgatgagccctgctcacaaggcctacctgcagcctgtcctctatttcctgagttccccccttccctcagtctccagctccttgccttagaggccaatatcaaatactgcccctcccttagaactctcccttgaacctctgtggccttttgtgggacctctcctcagtctccctaatttctgtgattaacttatcacctaattaaatggtatgctcctgtagggcagaaatctaattattccttctgggagactgtcatacagaatgagagaggtctcactcccccaagagtactagagagctcttcacctaacatttttcgcatcttgagattcggaaggatagagattgattactaggccttgcctttagcatttttgttttctccaacaaaattgcaaaaactttagaaaaatgggaagaagaaaaaacatgaatccctccttcctctaacacaactacagccttccctttggctatgacaaatgctgcccaacagaaatttagcatgagtcacaattgcattttaaatataacttaaatacaattaaattttcgagtagaaccaattaaaaagttaaacaggtgaaaatttgaataatataatttatttagcctaatattcaaaagtaagtatgatctcaacatgtaatcaatatatttaaaattatttattcaccaagtctttaaattcaacttaacagcacatctcaattcagagtactcacatttcaagtgtttattagccacatgtggctagtgactatcagatcagatagtataatccaaaaatagactctccgtaccccccctgccccatttaatgtgactaaaattagacatcatcttaaagtggatgtgaaaagaaacctgcctcctttttttctccccaaaagctgctattgttcaatccatggatttattgatggagtctaacaagcaaggaaatatagtgttatcaatttgtgtattccttcctggtctcttcatctacatgctccccacagggaaagtactatttatagcttgctgcttttacataatatattttttcgctaggtcatacagtgtgctcatgtttagtcattaggcatgtttcttttgggcaattggggttgcattcaatttttaaaatttaaaatttataattataatatggacatctctgtatatgtagccatttccatagactccaagaagttggatttctgggttgaggggtgcgagcatctgacctttttccgtgtgttgccaaaatgctttccaagaggattgtttttatatcctctttcttccatttctttctttttttcaagcaaattctaaagagtagtcttttggtagtgttttgagagtaccagtttcattatcactggaatttttttttttggaagagggtaactaattcagtaaacaaaagttagtaattttgtattctatttattacttgtgaaattaattgcttttccacatgtttatttactag

SEQ ID NO: 735273 - DNA, 1603 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctcagtagcaggcttggtcctgcttcttggggcctgagtaactgagtgttagagccgtcctgaggaaggacctgaggcgccagtgaggagacagtggaagctaggaagttggacatctggagacttgtatcttttctggcctgacctctccccttcttggggctcaggtgctctgcctgcagtagggatcacacctggcatcaggtgtctgaaaagagctttgaggtccttggagtggaatgtgctgtgtaagtaccagagactccaggtgttcagggacagtgagccctccccattgtcaatggtagtccaatcagggcagcctatgggctaggcccatgctgttctcaatgctcacacccgccttttcctacaaccacag

SEQ ID NO: 735274 - DNA, 71445 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtatagcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735275 - DNA, 1934 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaggaagtggggacgaatagtttactcgtaaagcgggatcctcag

SEQ ID NO: 735276 - DNA, 70591 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaatggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735277 - DNA, 71592 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaagaaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735278 - DNA, 71538 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtatagcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735279 - DNA, 2027 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaggaagtggggacgaatagtttactcgtaaagcgggatcctcag

SEQ ID NO: 735280 - DNA, 70684 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaatggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735281 - DNA, 1607 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaagggaacaaagatgaagttaaccctcccacctgtctttccttatgaacacttgccttttccaactgttttctgccatggctaatcagaaaaagtttcttaaggaaatggtggcaaaaaaaaaaaaaaaaagacacaaaggtaacaaacaaagctggacctatttataatgttccagtaagcagaagtacctagagactgacttgctaggatttagtctgttagaagatctcaagaagtcaagagacatgatgaaggaggaaaggctgaacttcagacctgcaacttcccagccagagtgaatcagccagtgacctaaccacactttgttcagagatgtcaaggaaaagtgttctctcggccaggtgccatggctcacagctgtaatctcagcactttgggaggactgcttgaggccaggagctcaagacaagcctgagcaacacagtgagacccccatctctacaaaaaataaaaacaaaaataaaataagctaggcatagtgatgtgttcccatagtcccagctactgcggaggctgcactgaaaggattcgcaggaattcaaggctgctgtgggctatgatcagggcactgcactccagcctgggcaacaga

SEQ ID NO: 735282 - DNA, 71472 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtatagcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735283 - DNA, 1961 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaggaagtggggacgaatagtttactcgtaaagcgggatcctcag

SEQ ID NO: 735284 - DNA, 1911 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaatgggttgaccttccaggctcaagctgagctgaaccaagggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttag

SEQ ID NO: 735285 - DNA, 71619 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaagaaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735286 - DNA, 71565 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtatagcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735287 - DNA, 2054 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaggaagtggggacgaatagtttactcgtaaagcgggatcctcag

SEQ ID NO: 735288 - DNA, 70711 bp, Homo sapiens
cggcgaggtcggtcattctgcctgtccggtagcaccacgaaacacctgccactgacacctccccaccagcccccgagggttcgcgcaggcatcccgagccgcgccccctggtccgccgcagccagattccctcccgggcgggttacgcccctaggcgcaaaacggaaccactccgtatgaagaagacaaagtataaccagtcacaccaaagagaggcagcattatttagacagccggctactcccccagagactccacccagtcccctgggcccggcgtccagcgcgcagacggtgcccggctccaggagttccagctccctccacgtgtcctgtcttcccagcagcctcctctgccgcctcgggaggaaaatctcctgacaactcgcggtctgcggactacgactcccaggaggcgccgcgccgcggctctccccgcccccccccgcccccccccccctccccgggacgcgcaggcgccttgggctccgtcaacaagccgggctggcgtcgcctggatgcggtttcttccgggatttgtagtttttctggagctacccgggccgtctgttagagggacaagaactacaagtctcggctgccccagcgctgcgagcctggtcacgtggcgggggccgaccgggcgtgcgtgccgccgttgatccggtgctgcagtgaggagcgtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaatccgtgcactggagaaggcgaggtcaatggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatcccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccag

SEQ ID NO: 735289 - DNA, 946 bp, Homo sapiens
aagggcgaaacgaaaaactacggctaggtacgaggctgggtgacgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggaggatgcggggagggctctccggtgaccttttctcgttcctgggttgggggc

SEQ ID NO: 735290 - DNA, 187779 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttcctttttgttttagtcaaaactgtgtgatatcgacgctgttgcagaacagcaggagctggagttgcatatttgcaattaacacagtgggcttcatgtgcctggacagctataaagattttattttaggaagctaaggttgaaatttggggccagtacctccctatacacacacacatgcacgcatgcacgcacgcacacacacacacgcacgcacacacactgtcctgtaaggttgaaatttggggccagtacctccctacacacacacacacacacacacacacacacacacgcacgctgtcctgtacctccctacacacacgcacacgctgtctgtacctccctacacacacacacacacacacacacgctgtccttatactggcttatctccctatacacacacacacacacacacacacgctgtcctgtac

SEQ ID NO: 735291 - DNA, 187860 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttcctttttgttttagtcaaaactgtgtgatatcgacgctgttgcagaacagcaggagctggagttgcatatttgcaattaacacagtgggcttcatgtgcctggacagctataaagattttattttaggaagctaaggttgaaatttggggccagtacctccctatacacacacacatgcacgcatgcacgcacgcacacacacacacgcacgcacacacactgtcctgtaaggttgaaatttggggccagtacctccctacacacacacacacacacacacacacacacacacgcacgctgtcctgtacctccctacacacacgcacacgctgtctgtacctccctacacacacacacacacacacacacgctgtccttatactggcttatctccctatacacacacacacacacacacacacgctgtcctgtac
